United States Patent 12,642,819 (COMPOSITIONS AND METHODS FOR TREATING INFLAMMATORY BOWEL DISEASE) - sequence listing, part 78

SEQ ID NO: 39 - DNA, 3340605 bp, Dorea longicatena (residues 1-1,670,303 of 3,340,605)
  modified_base (874732)..(874828): a, c, t, g, unknown or other
  modified_base (1572596)..(1573083): a, c, t, g, unknown or other
  modified_base (2166500)..(2166598): a, c, t, g, unknown or other
  modified_base (2425919)..(2426012): a, c, t, g, unknown or other
  modified_base (3280066)..(3280165): a, c, t, g, unknown or other
  modified_base (3318742)..(3319224): a, c, t, g, unknown or other
aaaatttaaattttaaaaaaacacttgatttttatatagttagctgcataaaaagcaggaagctgttcctgttcaggttccgtcggcgggaaatactaaagcatcaaaattatgctaaaaacgggcttccgaaatttgcaactcgccattcggctcaaacaggcaaatttcgaaaacccaacgcataattttgacgcttaactatttccaacaccttcttcacattcactggaacggcttcctactttttattccgtgggtatcaaatgccttacgaatgaaatggcaaatgcgtaaccgtagtggcttccaccgggttacacttccgggcattttatttattaacattcgctgccagtcacgacttgaaggaaacaatagataaggattattgtgaatgtggaatgccgttagaaacagttagagagtcagaagcaccgttaaaggaacgaagcgaacgtgtttgaggcgaacgccgagtttgagcgtagttcctttgcttttaggtgattctgactctcttagtgtttcttatggtatggaacctgaacaagaagccttatctattgtttccttcaaggactgagaggccgcttccccagttaataaattaaatcccaatttaatttagcatctcccgcaatttctcattcaccattccgggatttgcctttcctttcattgctttcatcgtctgtccgaccagtgctccgagggctttttctttaccgcctttgtaatcggcgattgcttttggattctttgcaatgacttcttttaacacttcttccagtgcaccttcatcattgactgtctttaatccatgctcttctacgtaactttccggatctacattcttttcaaatacctgttcgaatacttcttttgcaacggaactgttaatggttccgtcctctgttagcccgatcagttttgcaagattagccggtgagaagctgatatcttccggttccatgctgtgttcttttaacagacgcatggtttctaccatcagccagttggatactttcttcggtttcccacagattgccgtcgtctcttcaaagatatccgccatgtgtttggattctgtgagtatttctgcatcatactgcgggatatcgaattcttttttataacgttccagtttttcatcgcggaattccggctgtttttctttgatcttttcgatccactcatcatcgatcacgattggtacaagatccggttccgggaaataacgataatcctgagcatcttctttggaacgcatggcatgagatgattctttattatcatcccatcgtctcgtctcctggataacggattttccctcttcgatgagttcgatctgacgttctctctctccttcaatggctcttgcgattgccttgaatgagttcaggttcttcatctctgttctagttccgaactcctgggttcccacttctcttacggataagttgacatccgctctcatcgaaccttcctggagcttacaatcagatgctcccagatactggataatcgttcttaatttctccagatatgcaatgacttcttccgatgaacgcatatccggctcggatacgatctctacaagcggcacaccgcttcggttaaagtctaccagagatgtgtcatcccattcatcatgtaccagctttccggcatcttcctccatatgcatttcatggatacggacttttttctttgtatctcctactgcaatctccacatagccgtttctggcgattggctgataaagctgtgaaatctggtagttctgcgggttatccggataaaaatagttcttacggtcgaatttgcacactcttgtaatatcgcaatgtgttgcaaggccgattcccattgcatattctacaacttgtttatttaataccggaagcgatccaggcataccggtacaaaccgggcatgtatgtgtattcggtgctcctccgaatgcagtgctgcatccgcagaagatcttcgtctttgttgcaagctctacatggacctcaagtccaatgactgtctcatattgttttgccatgactatctgtcctcctttgcaagttctggtgcttcatatactttcgtctgttcaaatgtatatgcggtctgaatgattttattttcttcgaaacaatttccaatcagctgcatacctaccggaagtcctttggaatcctttcctaccgggattgtgattcccggaagtcctgccaggttgacggaaatcgtgtaaatatctcccagatacatcttgatcgggtcacttaagctctttccaagttccggtgccgttgtcggagccgccggagccacgatcacatcatatttttcaaacgctttatcaaatgctttcttaattaacgcttttgttttcaatgctttcagataatacgcatcataatatccggaactcaaaacaaatgaaccaagcataattcttctctttacctccggtccgaaaccttcggaacgggattttttgtacatattatgaagtccttcgtattcctcggtacgataaccgtattttacgccatcgaatctggcaaggttggagcttgcctcagctgatgcaatgacataatatgcaggaatcgcatattttacaaggcttaagtcgaattcttctacaactgcgcctttttcttccaaaacttttactgcccgaagaatattttcttttacctcagcatccagaccatctccaaaataatcttttggaataccgattctcatgcccttcacatcatctaccagtgcagatgtaaaatcataactgtcacgtctgattgatgtgctgtctttcggatcataagatgcaatggtctccagaaccgttgcgcagtctgtcacatctttcgcaacaggaccgatctgatccagggaagaaccataagcgatcagtccgtaacgggataccgttccatatgttggtttgattccgactacgccgcagaaagaacttggctgacggatggacccgcctgtgtcagatccaagtgcatatggtgcttcttctgctgcaaccgctgcacagcttcctccggaagatcctcccggaacatgctctaagttccatgggttctttgtcggtccgtaataagaagtctcggttgtacttcccatggcaaattcatccatattcgtctttcccagaatgacagctcctgcttcttccagattctttactgcctctgccgtgaacatcggccggaagtttcccaggatcttcgaactgcaggttgtgagcattccttgcgtacacatgttatctttgattgctaccggcacacctgacagtggccctgtcagttttccgtcatcaattaatttctgtacttcttctgcacgttttaatgcgccctctttatccaacgtcacaaaactgtttacatctttttctactttttcaatctgtgcaatggaggctttcacggcttccacaacagatatttcttttgctttgatcttctttccaagctctactgctgtaagacttgtaatatccataaccgttttcctcctatccgatcgtctttggtactttgaagctctggtctttttccaacggtgcattcgccagtgtctccgcactgccgtctccatttgtcacgacatcttcccggaatacattcttcaccggaaatacatgtgacattggctcgattccatccgtatccagttcatttaaagtatctatataatctaacattttttccatatctgctttggcatcttctttttcctgaccggataattccagttttgcaagaataccaacgtattctatggtctcatctgatattttgtttgccatcttcctgctccttctttcctgatgttatcaattcccctatactttatattcagtaaacttatctgttataaaagccataataatctgttgatgcaatctgttctgacggtgtaagccttattttcaagtcttctgacacttccattgttgcattttccggaattaccagataatggaatgtctctccgtctattccatcttccgacagcccctggctccatgaatttatttcttcctgttcgtctgaataaatgattacatccacatttccagcccctgatacacggctgagatcatatattcccggttcgagatctcttccagccgtcaacgttttctgacctttgatatccactgattctgtgagcggattactctgtccggccgtttccattgcctctacatcctgtgcattatcggtatgcagttttactgttgtcctacaatttaatgtaagatgcgctcctttataaagacggatatccttaatcttgtctttcttgccctcggtatattcatacagatagatgctgttctcaggatcatcgatctgcacggtgtcatagtcatcttgcggtgtcactgtatagattccctccgggatctccacacctgccacataattgccggaagtaagttcatagtctgcacgttctccttctttcgggatttcccgagtcacatactgataatgatcatagtctgtttcatccgtatcatttgtcttttgatcccccgtatcctgaaatacaccttgaactgcatctccaattgcatattctatatcgtacttatgttcctcatagagattacccaaaattgcaatcacgataattgccagaatcactattttcaatggtcttctccggtttgtaatatccggagtctgcacatgctttctccgttttttcccggtcatatcagactcattcatacgatagccttgttttccgtaatctctttttttatgatttgtctctttgtgatttatttccctgtgatctactttcctgtccggtctgtatttttctttctcctcatgtacatgtgtaagcggcattccgtcacagtcactccggttgatccggtaattcttatccgacttgctgttatcaagcccacattccgtacagattccactactgtttaactttcctccgcataaactacatctttttccaaacatatgatttccctctcatgacatgttatcaccagtatcatatctattataccttactccccgctatggttccagtctgcttaaatctcttgggaataatgtagtctctcttacgttatcttctcctaataactgcatcgtcaaacgttccagtccgattccaagtcctccgtgtggcggcattccatgcttaaatgttgcaagatactgttccattccttcttctgtcattcctcttgcagtaatcttatctgtcagcatcttgtaatcatgaatacgctgtccgcctgtcgtgatttccaatcctctgaacagaaggtcaaagcttagtgtatatcttggatcttccggatcatccattgcatagaacggacgtttcttagaaggataatgtgtgacaaatacaaaatcacttccccactcttctttcgcataacgtccgatcagcacttcttcctcgggctcaaggtcgaatggatttctcatcttgtgattgtatttctctgcaacgatttctttgatatctgcaaatttcactgccggaatctgactcacatcaggaagttcaacacccaatacttttaactctcttgcataatcttttttcagcaattccatcgcatactggaggaatcctgtctccattgccatgatgtcttcaaatccatcaatatatcccatttcaaaatcaagactggtatattcgttcagatgacgctttgtgttatgtttctctgctctgaataccggcgctgtctcgaatactctgtcaaatacgccgaccatcatctgcttatagaactgtggactctgcgccagcactgccggtctgtggaaatattccagtttgaaaatattggctcccccctcggctcctttcgctccgatcttcggtgtatggatctctgtaaattcctggctgtaaaggaaatctctgaatgctcttgtaagtccttcctgaattctgaatttggcacgctcccggatatttctaagggaaatggaacgatagttcagttttgcttccagagatgtgttcagtttccatttggaaatcgcaagcggcatcatctcgtcttccggctcacttaagatttttacgctctccatacggatttcaattccatttggtgctttttcattctcttctaagacgccttctacttcgactgttgctgcttctttgatatctttcagttcgaaatcagcactgccttcttcatagacacactgaagcagaccttctctttttcttaagatcacaaatgcaacagttcccatgtcacggatcgtatgcactgctccgttgacttttacctttgctcctgcttctgcctgttccaataattcactgatttcttttgtctcttttggctttacacctgttaaatactccatgttcttttcctccttttcttcccgggacgaataacggttataaacataaaaatccgccctggaatacatacttgtatcccgggacggatatcatcatcgttatccgcggtaccacccgcattgaatctcaaagctgtatagtgctttctaagattcctcttttcgtgcgtaacgtgcagtctacgtaccaacctacttttcattcaactttaccatatttacttgttcagctggtctgctccagagtgttccctattgtcctcattccccaagcagtgctctcagtcggtgacaccacattcctgtcaggttccagagtccagagtctctttcatcgctttactatactaaaatttgttttaaatgttagcacatgttttttcagattgcaagagggtattctgaattttatgtaaaatgtcttcctggcttttcatttatgacttgttatggtattatttactaaattaatgcaactctatttttgaatgtaacccgatcattccacgcaaggaggatatattatgactcagaaaaagaagtattacttttgttttgcacttgccatatccatctgtatgaccgtgctgattcaggtatttcagttgtattctttaccgatacttggtatattggagctttttatgctcgtgaatgtatgtatgatcgcagtgaatatatttaaccgcaagtgtttgaatcatgttggaacgctgattattacaggaagtttgtttcttttcctacttgcgcgaaatacatttttatttttgttttctttttctatttaattcactaagccagattcccgaaccgtaataaaagattacagttctccatttaattattatggcatgcgaaaccgcaggaataaaattacaaggtcctatcctgtgcatacggactcatggttggtaattcttaagtaaaaaagttgaccgtttgctcacaaaaaatccactgtctgagacgaatgtcgagtttggattttttgtgagctcgtttttaggtcaacttttttgctttagaatttccccatgttggagtcagcacaggataggaccttgtaagtttattccgatcggtgacagccgccataatgcattaaatagaaatcaattctaaaatccggaactcctctgcctctttccctatctgacacaacaggcaccgcattcccgcatccgtgatcttaccatccagtgtcatggttactttctgaattccattttctgtcatcagattcatagcatcaatctggattccatttaactttgtcatgttcacgaacaggttcagatcacttgtctcttttgggcaggtaaatccaatctttacctgtgtatgttcggtctcagctgtcagtcctgctgccgccagagctaccatcataactttttcctgcatctctggtaataattcatattcatattttctgcaaaggctcattaaatgtctcaggaatgttttatattcttcctgaatctccggatccacatccgtggctcttttttcaatgatttcaagttctctttcgagaacaaatacatctcctccggtctgagcttttacttctgctacatgttttccacatttcattcttcttaaaaacaatggcttcatatttgtatctatttcatcaatttcatttcttacttcttctaatgtcatcttagtttcctcgtaaaatttatactatattatatttttcaaatagctgctgacaatatgatttcctttcctctgctttcataaactctgcctccatttcagcactatcctttattatctgtacattagcatgaatctacaattcctctctgcctgtataaaatctctctgggttacaagcattgaaaattcatagaatgcgaaatgcataagttcttgatagggcgtatatgccaatgaaaatatagaattataatgcttaacccgattgtatcacatagtatataaattgtcgagtaaaaaatatatttgcttgcagattccgccatacaagttataataaatacgagagaatttatctttgggggttattatgattaaagctttgttcaaacacatttacaaatactataaagatacttttatcctggctattgccggagtagtcatcggtgttctcgtcggaatcatcgatgcagcattcgggctgggacttaatgcctgtaccactatccggacgaaatacttctggtatctgatctggttcctgcctcttggcggcgtcttcatctggttcatctatcaccagtttggcaaatctgtcgccaatggtatgaagatggtctttcacgtcggccttggtaaaaacaccaaacttccaatccgtatggtgccactatccgtcatcggaacctggacaacacacctgtttggaggaagtgccggacgagaaggtgttgctgttcagattggtgcggctgtttccaacaatgttggtcgtctggtcgataagactattgatatcgaaaacagccggaagatgttcctgatcactggtatggctgccggattttccggacttttctgtactccgcttgctgcaatcttttttgcactggaggtattggttgccggaaagctggaatatcatgctttgatcccagcaacagtagcttccatcagtgcagcatttacatcacgagcgctcggacttcggaaatttcatattaatatactggaaaccctgaactatcatccttctacgtacaacgccgtttttcttttaaaactggcagctatgggactgtgcttcggtatcgttggttctttatttgcactgattctccgatatctgcgtttgaaattcgccttccgtttttcttcgcctgtaaaaaaggttctgatcatgggggctgttatcgcagttcttatgatggtctttcatcagggaagatactccggaactggctctaacctggttgctctgtgctttgacggtattacagacgatatatacgcatatgactggattcttaagatggctcttacgattctgacactttcctccggattcatcggcggcgaagttgcaccactgttttccatcggttcctgcttaggatacgtacttggaccggtattcggatttgatccgatgttcggtgcagctcttggattcgcttccgtcttctgcagtggatcaaatactttgcttgcagctattctggtcggcgtggaaagtttcggatataatatgctcccattcttttcggttgtatgttttgtatcgtttatctttaactttaataattcgatctttacagcacagagagttgcatttacgcatcctgtacggcgtcagcggttgaaacagcggattgcaccaaagggaaattaacgtattagcatatacatagtagttcctgcaagtagcaatgtatcttacatactttgtatctacaggacttaccactggcagctctttacgaatgcatggcaataaaaaataagtgtacattcttccaccgaagaattgtacacttatttttattctcttatttcaatcttaaattcctataacacaatttccaagtcttccagaacctgcctcagactcctatgccatgattggtttcagtgcctcagcaagtttgtccttctcagcctgtgcctcagcaagatctttaccaagtgttgtgtagtaaatcttaatcttaggctctgttcctgaaggacgtacgataactgtctcattgttctcaagcttgtaaactaatacatttgctgcaggaagtcctgtttcttctgtcttagtataatctgttacttctgttaccttgtatccagcaatctctgccggtgcattctcacgcaggttctgcatgattccagacatcttgtccattccactgagtccagggaattcaaaactgtcgatcttgttgaggtaacgtccgtactctgcatagatctcttccagtctctgtttcagagagctgccgatacttctgtagtaagctgccatctcacagatcagcatagatgcgataacagcatctttgtcacgtacatatggtccagcaaggtatccgtagctttcctcgaatccgaagatgaatctgtctacttcgcctgctgcttctaactgtgcgatctggtctccgatccatttgaatcctgtcagtacgtttcttaattctactccgtaatgagctgctactgcatcagcaagtggtgtagatacgagagattttactgctactgctttttcaggcattgtacctttctcgatacgtcctgcacatatgtaatccagaagaagtactccgacttcgttaccgcttactaattcataagatccatccgggcacttcatagcgatacctacacggtctgcatctgggtcagttgcaagcataaggtctgcatctgactcttttgcaaggttcagtccaagctccagtgcctcaaagatctctgggtttggatagctgcatgttgtaaagtatccatttggatattcctgctccggaacgattgtgatatctgtgattccgatatcttttaatacctgtgttacaggaacaagacctgatccatttaatgggctgtataccagttttaatccggctgtcttacacagtcccggacgaacctgccgggattcgatcgcatcataaagtgctctcttacagtcatctcctacaaatctgatcaatccttcttctacaccttctgcaaatgacatatattttgctccggtcagaacgtctgtcttctgaatctcttcgtatacgattgcagccgcatcgtctgtcatctgacatccgtccggtccgtatgctttatatccgttgtattttgccgggttatgagaagctgttaccataacacctgcattacagttataataacgtgttgcaaatgaaagtgccggtacaggcatcagtgcatcgtagattcttactttgattccatttgctgcaagtacacctgctgctgtcttggcaaatacatcactctttaaacggctgtcataactgattgctacagtctgtgttccgccctgtgtctttacccagttagccagtccctgtgttgcctgacgtactacataaatattcatacggttcgttcctgcgccaagcacaccgcgaagtccggctgttccgaatttcagtgctactgcaaaacgttccttaatttcatcatcgtttccctcaatttttgacaattccggcttcagatctgcatcttcaagatctgccgcaagccagcgtttgtattcttcctgatacattttttatcactcctacttatttcttttccgggttttttgtatattttcacaacaaacctattaataatataccattttttatactttcaggcaataaatgtactgtaaattatgtgaaaacttttcgtcatttttctcaaaaatcagaaaaagacggagggcacattttctgtgctgtttccgtcttttttctgaaattccaaattctttctattgatatgttttatttatctaccgacatcatattttctacgattgaacttccgacctcatataccatattggaatctttaagctgtacataacggttatcaccatttacctttccaacatagacagtacacgtcttcttatcccctgaagtactatccttataagttgtcgttaccgtaatccggtttgcttcatccagaccatattttgcaagatcttttacattataatctgcacactgggtaagtgagatagttccccatccgcctgccagttcggcccgctctttctttttcttataagtcgtagtcttaccgttttgtgttacctctaccttcttaaggtttccactgctgatcgatggcattgtgtcgttctccgtcagagatgacaggtcgaatacaagatccgataccagtgtacctgagatggtatacaccgcatccgaatcctcgatcattgcataataattgtctccggccgcattaccaatctgaatcgttcctttggttccatcctttgccgtgtaggtaacggtgtaatccgaactgtccagtccataatctgctttctcatccggatcactcagcttgcggaccgctgtcagtccagtaatctcttttgccgtgctcttgatcgtactctgattcagacgtaccccgtcatcctcatcgtatacccattcgccatcatctttggtaaagctcatcttgcttccgccgctttcataggaaaatgacttcagactctttacatctaccaggctgactttttctttgtcctcttttgccttcttctgcttctcactgtgactgttccaggcttttaatcctccgtacagcgcaagcaagaccgcaagcacaatcaccatgatgagcattgtctttttctgtttcatcaaatttccccttttctgtccataaatcttcttaatttacacttttcttctcttccaccagcgcataaatccatagatcaggattacaagcggaattccgaagattgtcaggatgctgatgattcccgcatgctgcatcgtattgttgcttacctccaggctcttcgccttgattgctatattttttgtcttgtcaaagttagctgtcaccgcattcatgaacagatccaggttctccagtgttgtgtaagtatctgtaatctgtgaattgatcatgctttctgaagaaattaccgtcagacggctggtttgggatgagctgctgtcggatgaatcatcagatgtaatctgctcagtcgcaactactcctaatgtataggttccctcttcctgcttatcctctgtcactgcataggaattatctgatgtctgcataaacgccgttgttgtgatcgtatctcttgccggatctgttgtagtcagaccatgtgcattgatcatcagaaccatctctgattccagattattggccagatcgtctgttgctgtgatctccgggaagatataataatagttgccctggtagcttctctgcatatctgcgatgtaaccgtccgcttcctgcataccatattctttcagcacttcatccagattcggtgtctcatcctcaggatctccaagaatgataaatacctttccgccctttttcaggtaattcagaagtaatgttttctcatcatcggaaatgtcttttgatggagcatccatgaataacagatcacaatcatcaggaatttcaccggtcatcatcagattcacttcatctgtcgtcagattattcttagtgaacagttttgtcacagaatctgaaaatgctgcttctccgtgtcctgttgtataatacatcttctctgtctgttcactagtaaccgaattgatcgcacttgtaaactgaccttctccgtcgaattcagatgcagaactgcttcctgtcgtatagtaggaataagaatccgaaactaaaatatcatcaaaagaaaccgatttcgtttttccggtatctttgcaggagattacgatcgtatctttctctactcctgctttcgtaagtgctgccggatgcaggaccggatcgatccatgttacactgagcttatcagacaatgccgtatatttcttgatgaatgatttgatccttgtatctgtcgaatctttttctgcatagattttaaatgttacttttttatccagtttgttcaatacctttttactggtctttgatactccgtaaatgttgttatcactgatatctatgctcttaacattctccggaagctgacctgcgatcagattgacaacgatcaccatgcagatcacaagtgcgatcattcccacactgtaacttccgtttttcgatgatgcactccggaatgacttcttgattttttctaacattatgctcctcctaactccaacgtctcttctgaatcatctgcatcgtcaaaaagaagaacaagacgatcagtgacaggtacaatataatcccgctcacatccagaagatggttatcggcaatattggaaaatacttctgtcagttccagtttgccaagtactgtggaaagcagactttcaaacactgttttctttacaaagtaagtaatcagtgttcctgccagtacgatcagctccagtaccccgctgatcacgacatttttcgtcatattccagactgcaagtacgaccagcgtcaacaacaccgcaactgccaatgcatttgcccatgctgccgaagggataaagttcaggatgccgctccagagataagtcagaagcaggataccgaatgcgccgattgccgcaatgatcacactttctgtcaatgaagagacaaacattccaatggaaatatatacgcatccgagtaagaaaaacacaaggattgccaaatagtctaccttaatgtatgccgtcccctgcgccttaatgatcagtggaaagatcagatagatcacacacggtacagccgtgattgttaccattgcaagatattttccaagcacgatctcgaacaggctgaccggtgctgtcagtaacatctgatccgtcttattcttcttatcttctgcaaagcaacgcatcgtcaggatcggaattgctaccaggtatacgaacagaatccctgacaatacataagaaaaatacggatatccatagttcagattatacgccaggaaatagattcccgtataagctaccagaaaagcgataaatacatatcctatcatagaatgaaaataggatcttaactctcttttatagatggctctcatcttacttctcctcctttatcattctattgcctgacccttgtgtcagctccagaaatatctcttccagtgttgtcttactctgattcagggtaagcatcggtacatctgcatgggaaaatgcaaggaataactcttctctgatatcttccccgccttttgctataatctgcgcagttgtaatgccgctcgcactggtgcggtattttacttctttgatctttcctgtccggcggataatatgatccatctcatccctggaagcctttgcttccacctcgatctgacctttgccactcatcatattctccagattctcggtcgtatcactggcgaccagcttccctccggatatgatcatgatataatcacagacttcccttacttccgcaagaatgtgagaacttaagatcacggtatgtttcttcgcaagcttcctgatcagttcacggatttcgatgatctgcttcggatcaagacctactgtcggctcatccaggataatgatctccgggaatcccagaactgcctgtgcaagtccgactctctgcttataaccttttgacaggttctggatcagccggttttctacgtctctcagctttgcaagtcttataacttcttctatctgcggctctcttttgtcttttttaattccttttaattctgcagcgaattccagatattcccgcaccgtcatttccatatataacggcggaatttccggcagataaccgatattcttcttggcttcttccggctcctttaaaatgtcgtgtccatcgatcagcacctgtccctctgtagctcccaggtaaccggtcataatgttcatggtcgtagattttcctgcaccgtttggtcctaagaatccatagattttaccggattctacggtgaagttcagatgatctaccgccagatggttaccataacgtttggtaagattctttacttctatcaaatttccttcctcctgttaaactcaatctgttaacaatataagggggatgtttgaaaagtatgtggaaaaaatttgtttatttgatgaattaaagtttaactgttaaacaaaaatattgtttttccccggacgcaaacagatacacactatattcccaagtttctcctctcacttcgttcgaagtcaacttttgtgaatatagtgtgtatctgtttactgattatactccgctttctctctgcttccttaaatacccctggtagatacggctgctgatgattcctttcaacacgttggccgcactcctttttacatcttcttccagaataatacctttggaaactgcttttacgatgtcatctacggttccggaactgcctggcataatcaggtcgttgcctgatgcaatcgcatgtgccggatcaccgtattttcttccggttgcgaaccagtcagtcataacgaaaccatcaaatccccattcattcctcagtacctgtgtcagcagacgatagctgttgttgacgtatttgccgtttaccttattatagctgctcatcacagctcccggatgcgattctttcaccgcaatttcaaatcctttcagatagatttccctaagtgctctttcatttacgttagcattcgtcttattacggttgtcttcctgattattacagcagtaatgctttaatgtaacataacatccgcggttcttctgaactccttttgtaattgctgccgcaaattcacccgtaagtaatggatcttcggagaaatattcaaagttacgtccacataaagggttgcggtgtatattcatgcccggtgccagccagtaagttacaccataagcttccatctcttttcccactgcattcccgacctcttctgcaagctgcagattccagctcgatgccagagagattcccaccggaaatgccgttgtaaactgatacagaagattcttgctgtccggattgccaagcattactttctttaccggttcgggaagatatttcataaaagagatatttggttctactccttttactttacccgttatagatacagacgatatcttatgaagcctgagtcccgcaggtccatccgccataacgacatttggaattccctttgcagtcagatttccagtcgtcacgcctgctgctcccggtgcttcaaagaaccgatgtccggacatgcctccgcccacaaccagctccgccatatctcttagcgttaatgattctaagatcctgtcagtctcttccgaagaatagatctccaccgggccatacttatgatccgtttccggaataatccccggttcgatctgaaagctctgaattttttccacatcgtcgatgattatttcacaggttcttccccagttctgtctgcagtcaccggttgcatgaagaagttccttttcttcctgccattccagttctgtcacccttaacggtgccttacagatatgagaatgtttctctgtaattatttccgtttccagtcttagtattccacatactcttgtattcctgctggaattaccgactcgcacgacatattcgcccggttccagaacagtggcagcatctttttccctgtaacttgtaagatcacgcagatcaaattgtaatacggtccgttcttcctctcccggtttcagattctttgtcttggcaaatgaagttaatcgctgtgcttcttttttcagttcaccatccggacagcttacatagatctgtaccacttcttttccgctgtatacttcgcctttattctttacatctacggatatctcgacggtagttctttccagcctcatacctgcaagatgcatttcgaactctgtatacgatagtccatatccaaacggatatcttggtgctacatgaaatgtatcaaaataccggtatccgacatagatcccttcccggtaatactcttcatcgagattcccattcagataactgtaatcatctgacgccggatagtcccggtaatgctttgcccatgtatctgtaagtttcccggacggtgtatgctttccgcagactatatccgcaactgcctgcccgcccatcgttccaagctgtcccatgaagatcaccgcattgatgttcggaatctcatgcaaaaaattcaggtcaaactgccctcctacattgatcactacgatcatatgctcatattgttccgcacaaaatgtcagatttactcgttctatctctgccagaccgtattcattctcactgagtttacggtcagcaccttctcctgcctgtctcgaaatgacgtaaatgcaggtatcggtctctgatttttctacatcttcctgcagcactgctcttccatatggatagcggtatggactgctcatcagattcataaaatccgacagattcttcggacttagtttctttcggaattcttctgcgtatgcacgctctccttcctgaaaactctgatcataatcatcaatccagttcatcgttgtaatcttgaatcccgcatcttccattccttccaggatcgatactgcatgccgttcattgacctctcctgaaccggtcccacctttgatcgtcattttggcaccggctccgtatagtgcaatttttcccggctttaacggaagacatccgtcattctccaaaagcacgatcccttccactgctgcctgatatgcaatttcctttccggcttcctccaacggtgtgactgcatctgttagtgcggctttatgaatgtttcttgttctcattgtaattatgcatcctttctattttccagatgatggcatatatgggcgcaatgctcctgccacattactgattggcattgtctgaagccacacttttccaggtccgtgaattattgtattaaagattccttctccgccaaataacatattcttcacacccggtacgctcttaatctctatctggcatgaagcatccattgcagccagatgtccagtatctacgacaatttcctgtccgacgttcaattcatactccactacatgtccgtcaaactcagcaaatacagttccctgaccagataccttctgcatgataaatccctctccgccaaataatccagaactgaacttcttattaaagaacacagacaattctacccctgcttcgcttgcaaggaatgcacttttctggaataccatctcgcgccccggttcgatttcaaatgctttgatggatccaggaaagcacgatgcaaatgcaatcatccccttgccagcttgtgcggtataaatattctggaatatatgctcaccggaaaacattcttccaaatgccttgccgattcctccattcgtggtcgtctccatcttcatattcggtgacatccatgacattccgcctccttctgtgatcatcttctctccgccctccagatagcagataactaccggtaatgtgtctcctttgatttcatatctcatataagtttcctcctgaaattttatttttcttttaatatactttttcccgaaaaactatatttatattatagcatctactatctctattcacaatcagcactttatatttacgtaaaattttattacattttcaccataacaactcaaacatgacaaaacgccaaaaatcttccgggcttttcatcccttctgatttttgacgtttttctaacatcttataatgtttttacaaatcttaaaaatgcttctcttcccttttctgtacatttatacactccggcatcctcaagtacatgtacaaatacttcaccgacttcttttttcaatatatccattacattttcttctgtaatcccatcatattttttacaaaatgtatctgcccagtccgcatgttttgcaatcttttcattacttctgatatcttttttctgaaccagataatccgcaagaatctccagctcttcttttaatctggatggaagcaccgcaagtcccataacttcgatcagtccgatattttcctttttaatatgatgatactctgcatgtggatgataaacgccaagtggatgttcttcggttgtgatattattccgaagagtcagatccagttcaaacaatccatcacgttttcttgcaatcggtgtaatggtattgtgtggttccccgtctgtatttgcatagatgaaggcctcttcatcggtatagcctctccagcatccgagaatgtgatctgccagtttgatcagacgtttttcatctttatgacggatacggattacagacaatggccattttacaattccagcttccacatcctcatatccaggaatctctactggaatctcaatcggtgcttttgccattgcaaatgtataatgtcccccctggaagtgatcatgacttaagatagagcctccaacgatcggaagatctgcattggatcccagaaaatagtgtgggaataactttacgaaatcaaataatttctcaaacgctttcttatcaatcttcatcggaatatgctgtccgttaaatactatacaatgctcgttatagtacacatagggtgaatactggaatccccattttcctcccgcaatctcaatcggaatgattctgtggttttctcttgccggatgatccagccgtcctgcatatccttcattttccatacaaagctgacatttcggatatgctgtattctttgcatttcttgccgctgcgatcgcctttggatccttttccggcttagaaagattgattgtgatgtcaatctcaccgtatggggaatccactttccacttcatatctttcttcacacggtatctgcggatataattactatcctgacttaatttgtagaaatattctgttgcagtttccggcgattcttcgtatttttctgcaaatgtcttctgtacctgggccggccttggcaccaggcaattcatgatctttgtatcaaaaagatcacggaatccgatgctgtcttcaatgattcctctttttactgcctcatccagtaatccttccagaactgtttccagttcgatggagcttctgtcgatttctacatcttcatatgaatcttcctggaataattctaacaataaatttgttgtgtaaattctctcacattccggtgtcagtccggtctgaataccatattctaccagtttcttaatattttcatacaacatattatgatccttccgttcctttttctatcctgtgaatttatacaatctttgctccgtcaccaatctctactacatagaattctgcttcatgtccgactttttctttatatgtctttccaatctcttcgataaatctgtccactgttgcatcttcaacaatgctgaccgtacatccgccgaatccgcctccggtgatacgcgaaccaataactcccggcatagcctgcgcaagatccactaagatgtcgatctcttcgcaggacacttcataatcataacgaagtgactcatgagatgcattcataagctgtccgaataatttcacatcgttgttacggagtgcttctactgcacgaatagttctctgattctcatataccgcatgtttcgcacgcttctgtctgaccggatctttgatcgcatccttgtactgttcgaatccgtcctctgtaagatctccaagtgtctttatatctgtaaccttctgaagttcctttaatgcagtctcacattcatttcttctgtcattgtaagcagaatcaaccagactgtgctttaccttactgttgatgatcacgatcttcgcattttcaagaacgaccggtgcatattcgtattttaatgtattggtatccaggaaaattgcatgatctttcttacccatcgcacttgcgaactgatccataattccacagttgcatccattgaaattattctccgaatactgtccgatcaatgcaagatcgatcatggagagatcttcaaatccaaatgtatcttttaacatcagtcctgtcagcacttccagtgatgcggaagaagaaagtccagaaccattcggaatatttccatagatcaggatatccattccatgtgtcagttcataccctctcttttcgaatgcccacattactcccttcggataattcgtccatccggcatttttactcggaatcaattcatcgagacttgtctcaatgattccaagtttttcaaaattcaaagagaagaaacctaattttctgtcttctctgttccttaccactgcccatgttcccattgtcagtgcacatgggaatacatgacctccgttataatctgtatgttctccgatcaggtttactcgtcctggtgcaaaataagtacggatttccccgccttctccgtataattcctgaaattttgcgatcaattgctctttctgcattccattacctccatttgtaatacatttttatcattttttctttcataccttaagtttcaggccttctttaacatccacttacatacttttttgtagttgactgtcttctgttattgctataatataatcataatgagatatgcaaattctcacaataagaatattggcatattttataagaatattgagattttatttgtttttgacttttatatacggaggatgatatgaaaggtattcagattcttacagaaaaaaacaaaaaagaagtaaaagaacacggaagttacactttccccgttcaggtatccccagaggcaatacagtcttatgaacagcattccttcatgtggcactggcatccggagatcgaacttacatggttcgtatccggacagatggaatatgtcgtcaatgaccagcgttatattatctcagaaggcgaagggatattctgcaacagtaatgctttacatgccggatatatgattgatgaccaggactgtaattatatctctgtcacatttcatcccaaattcatctatggctacgagaacagtatcctgcagaccaaatatgtcgattttatcacttccaacgaattctggtcttcacttgtattaaagccagagatttcatggcagaatgaaattattgaatacataaaagaaatatatacattaacctgccaggttcaatcttcttccgatgccttcattcccggatatgaaggcatagcggaacagccggaacttcctgactatgaattccgtattcatctcctgctctgtgagatctggcaccggctttatctgcattatgtccagattgcccaggatacaccacagccacagaagcatctgcaacgtttgaaagacattctttcttatattcaagaacatgcctcggaagaacttggtctcgaagatattgcctctcacgccggactgtgcaaaagtgaatgctgccgctttttcaaaaagtatatgcggatgaccatcttcgattacctgctgtctacacggatccagaacagtcttccacttcttatgaatggagagaatattactacgattgccggacttgtaggattttcctcaccggcatattatggtcagatttttaaacgttatatggggatgtcccccagccaatataaaaaacatgcagcccaatcatcttccgctgattaagtgatgtgctttcaaactggtatggtgttttttctcataactggctctttatctcatgccactactattgtaaagtaatgacaattacgaaaggaaagagggtttttgttatgaattccaatctgaaaaaaataattatgacagcattatttgctgcattggcctgtgttgctacgatgtccatccgcattccgacacctggaaccggcggttatatccatccgggtgatgcgatcgtaatccttgcaggtatcattcttggtcctgtatacggtatgcttgccggaggtatcggttctgcactgtctgatctgatcggcggctattttgtatatgttccgatcacactggtgatcaaaggacttgtcgcactagtatccggactcatttaccagaagatgtgccgttccggtaaaaaacgttatatcgcagtcatccttggcggtatcacggatatcgtattcgttgccggcggatattttatctgcgaattcttcctttatggaagcggtgctgccgcaagtattcctgccaatatcatccagggagtcggcggactgatcatctctgcagtattatatccggtactgatcgcgatcccggatgtccgccaggctgcttacgaggcgaaaaattaacttcatttgcatgctttactatttatagaatcttccaccggcagtttctttcaaatgtatgatgaacaaaaaaaggataagttcttttccactttacaaaagaacttatcctttttccacatctttttactttacttgtccactttttccgcagtactttttccacaagagcatccgatcacaaatgcaaggaataagaatgccacgatcatccaaccgatcagtgtctttgttcccattggttgaaatttatcataatatcccttcaggtaaatgataatgatcaggagcggcagtccgtaagacatataacccttgattcctgccgggaacttccatccttctccttgattgatttcttcaaggaagctgttccatccccatccgttcttctttgtacagaacaggacatagccaagacttccaagcggaagcaggttattcgatacgatgaagtcctccagatccatgattgtcgatccttctccaagtggagtgaatccggccaatacattgaatcccataacacatggcatacttaagataatgatcagaatcagacttaccagtgtactcttctttcttgaccatccgaataaatcaatatcaaaagaaataatattttcaaataccgcaaccaatgtcgtaaatgcagcgaagcttaagaacaggaagaataatcctccccatacacgcccgcctgccacctgcgcgaaaatattcgggatcgtgataaatataaggcttgggcctgctcccggttcaattccgtatgcaaagcatgccggaataataatgaaacctgccatcagcgctacgaccgtgtcaagcacggtaatattcacagcctctccgaataaacgctgatctttttccatataacttccaaagatcaacatcgctccgattccaattgataatgtaaagaatgcctggctcatagccccgaaaatcacgtttccgattccgatctctgccatctgtctgaaatcaggaatcagataaaagcggattcccgctccggcacctttcatcatcacagagtggattgcaagtacgatcatgatcaaaagcaatgctgtcatcatgaacttggatactttttcgatacctttctggattccaaatgcacatacaccgaatccaatgatactgatcagaatcgtccaaaatgtcataagcggcatatttccaagcatatcactaaatcctgcagatacagtcttcatatccgcacctacaaaatctcctctgaagcttctgacgcaataatacagcatccatccaccaactgtggtatagaacatcatcaggaaatagcatccgataacaccgatccatttcgtaatatgccactttgttccttttggttccagtgtctcatatgcagcggcaacactgtgtctgctcgcacgtccgacaccaaattcacagaccataaccggaattcccatgatcagaagaaataccagatatatcagaataaatgcagctccaccaaactgtccacacatatatggaaatttccacacattcccgatgccaacggcacaccctgcggatacaaggatgaagcccagtcttgatccaaatgtctctctcttcattccataaacctctctttgttttaagtcaagcattttttattatatcgcatattatcagccaaacgcaaggattatccttatggagtttttagattaaaaaagatcaagaaaaggtgtcagcatctgatgtgggctttcccacattccagatacttatgctgtacaggcattctgaagaatctcatttaatgcatttccactgcttgtatggcatctcacgatttgtgcattgcatttttccgcttctgtcactgcacagtgtaccatcttatgagatactgtgttggtaaataagatcaacaaatcaggacttcctatcttttcacttaaatttccagacatctgtgtgaatactttcgctttgcacttgtattctttacagatttttttatattgatgaaccattctgtcgtgtccgcctacaattactatactcatgtatttcctccttttatgtacataggttagctttatctaactaaaataatacatgatttttgtaaaaataggaagaggatatgttgagaacatttctcaatatatttattacacaagaaacaccactcctttcggggtggtgtttctacgcaaaaatgttatcctgtttttttaactttctgcaaacaacttcagcagcatccggatattatccttatctttttccttttcttcttccgtcaattcatcatatggtatcagatccttgtggatccgaagcgtggcatcttttctcgcaccatttttcggaattcccattcgccagttgtgaaactgatgatacctgcaccaccggatatgttcgagttctgccagaagttccatctgttccgggctcaaactggtaacatccatactccatccgtctgtcttcatcatatgtacccgtatcttatgataatcggctgcactgacattggaatatctcgtaaatccatccagttttccccattccagttccatattttccgaattttcctccacacctccgtacagatgtgcataatgaagattcaatttctttgcatgctcgaacatctctgttcccagtacgttggccggattccatgcttctttttcccattccactacatgcagacgttctcttcccgataacagttcaaatccatcgtcttccaccgtaaatacttcaaaagctgtacccgttgtagatgccagaagctttcctgccattccaagttgccctttctgcgggagcagaaggatcctgtctgcagattccagaagcggtatgttctcataccagtgttctgcatgaaagatcaccgggtcactcatctgggacagttctctgtgcgaagcctgaaattctgctccgtctccaaagatatgatactcgatccgctgtttagggtcaaaaatattatcctgcagtgcatattccagaagtttttcccctagaagtccgaatcccagaaatacaatctgcaaacgatgtccgtgtgcacaagaggtttcatacaggcaattccttctccagtataatctggccgccgtttcttccggacaaaacaggcgtaaatgcggatccaggattccctctgccgcaagattttcggatttcagataaacggtatgccccgcaaatgcttctctgtgctgtccgtaaaaccggaaattctcgtcctcatttccaagaagcaggtattttttcgctttcacccactcccagtcttctccggcatctatcccgcaggatcccagtgcctgtaccatttctttccggtgaatattatccccatatacggcaatgctgtctccgcggtaataccgcagcaactgcaatatctttccacggatctttgatatcgacatcagaactccgctggccgtcataagcggtgctgtccatctggcgatctcgatcagtatattcggcggtgaatccgaataattcaggaaatacatctccatactaagaaacagcgaatccaccaccggctgaccatccagaaccgtaaatcctgtaacacccatgacaaacggaaccaggatcagcagatattttcctatattgcttttcttctctttcattctttttctcctatgattttttaccgcctgtacaatatagtacatcaacggaatctgatcttcaatctatataagatccctggtacaataaaatcactgattcagtcaaattctatcacatctttatatttctgcatatattttctatttaatgcattatggaggctatcaccgatcagaataaacttacaagatcctatcctgtgctgactgcaattgccgatgggattccaagttcaatctgatttatccggagcggtaaagaagattccacataaaacaaaaaaagctttgccgtctcgtctcccacaaaacagcaaagctttttcttactctatctctttcttctcctgcaatacgttttctcccattcttcttctgccagttcgtccaggatctctgttccgctggcactcttattaccgatgatcgtacgtccggttctctttgacagttcatcgatcagttcctttgggaatcccgtctctgtaaatgtcttgaacggagttgtgatgtgaagtcccatcatctcccagtgtccggtcatggtgtcttttccgttgcttgcttctcttaattttccataataagccaacgttttttctacaggtgcaacacctgcaagatcttttaagttagcaattccaagtttctgcagattcggaattttaaactcttctacatttgccgcaatatgtcccagggtatctgtccccgcatcaccataagaagcggcgtccggcatctctccggcgccgagtgaatctatgactacggtaaatattcttttatattttttttcgttcatattatacaccttcttaattctcgtatatcaaatatctggaacagtaacgtatttgcattcctgttccagaattttttgacaacattatgactcaccctgtttatgacagctgtcaggaagaactggacagtgttgaactggatttccgtatcgagccgccatcaaaatcaattttagacaactttgaccactatacggctgctgttgtcatcgtcgaccgctggtataagcatgagggacataccattgcgtattctttaagttttatcccgatcgagctggtcggcagactgcagattgacctgaacagcacggatgcccttctgaattttctggaacatacctgttatgaacaagaccatcactgcagccgctgtgttacgtattctactgccggaaacttctctgcaaagaattataaactttccagccatgattctttccttatgacacatgagaatgtgtatgatgagaatgaggagatacttgtggttagtaagcattatataccggcagagatgtttgaattgaagtattctatttaatctaccagactgactacccagacctcctaaaaagtggatgtgaaaaaactcgattgagttttttcacatccccttttattccgtgaatatagaatgcctgaagaatcaaatggcggctatcacatctgtcaccagtttttcaaaatctttcgccaccctgtccgccgtctcctgaacttcggcgtgattaagctttgcatcactgacgcctgctgccatattcgtaatgcaggagattccgcacacttccattcccatatgtctggctgccatggcttcgcatgcagtactcataccgactgcgtctgcgccccagcttctgaccattcggatttctgccggtgtctcgtaattcggcccggtcagctgtacgtatacaccttcctgaagtggtattccgcagtcttttgcacttttacggatgattttctgaagatttttactgtatacctcactcatatccgggaatctggttccgagttcttcgatattcggtccgatcaacggacttggcactgctgttgtaatgtgatctgtgatcagcataaagtcacccggtctgaatgatggattgactccgcctgcagcattagtcagaagaatcttctttgctcccatcatccccatcagtctggtcggaagtacaacatcctgcatagagtacccttcataataatgtactcttccctgcattagtacgaccgggacatctttcacatatccgaagacaaactggcctttatgcccctgaacggtcgataccggaaagtcttcgatgtctgtatattttacgatcttttctatctggatcttctcggcataatctccgagaccggatcctaagatgactgctttttctggtttgaaatccgtcttttctcttatgctttttaaacatttttccagttttttatacatacttcaacatcctttctttcaccgcatcatccgcaaatgccacatccactgcgttcctcatcataagatgaatctcttcatcggtgattccataattcttctggataaattccagttcttttgtcagtgtcgtattactgactgtacggttatcggtatttaccgttacctttaatccggtattcaggaactcccgcatcggataatcctttgtgctttctaccgcttttgtctgcagattgctgatcggacacatctcgataccgatgccttttttctgcaattctttctgtatatcggcatgccctctcatggcaattccgtgtccgattcttccggctccggcttctactgaatcgagaatattctgtacgctcccgcattcgcctgcatgtaaggtaaatggcatgccaagtgctttcgtctttttgaacagttccatgaactctgacatcggatacaggctttctgctcctgcaagatctgccgcgcatactccatatcccagatatgctcttgcagtccggatcatcctggcattctcttcttcactgtgatgacgcatggcacaggtaattactccatactctataccgaaatctttctttcctctttccagtccgttaagcaatgcttcgataactttgttacagttcatatcctgcgtctcagacagaagcggtgcaaaacggatctctgcatagcagacattttcctgtttcatacttcttaatacatcatagccagcttcttgcagtccggcttcatccataatacattttcccggaagatcaaatttctgcaaatattcattcaggcttctgcagtcgtcagatacactgagttcactttgtgatactttccgtcccagtcttttttctataaatgtgtggctcagcgatccgtccaaatgacagtgcagttcgacctttggcaatgcttttaattcttctgctgtcatgatttcccccttactcttttttcagattcccaggtccgaatcccaacggtaataactcttttaacgtatagatatcataatgttccagatctgttgcaagaatgatctgaaatgtttcaggatcacagaattccatcattacctgtctgcacactccgcacggcggtgcatattctgtcaagaccccatcttttcctcctacaatacagatcgcatcgaattccttcacgccttcacttactgccttaaaaaatgctgtcctttctgcacagtttgtcggtgtatatgctgcattttcaatattgcatcccgtatatacgcttccatttttcgccaataatgcagctccgactttgaatcctgaataaggtgtgtaagaatactttaactgttctattgaaatttcgatcagttgttttggattatatctcggcttgtttctattctctgtcttccccatcttgtttcccttcttctgttattctttttctttatcacaccggatcagatttctcactgcatctactgctgtccggatcgccatatcagtatcatgcaccaccggattttccaggccgagcttctctctttcctgatttgccataaccaaaaagcatgcacctgctctgacacgcaatttaccggccactatgaaaagtgccgctgattccatctcggaagccagacatcccatcttcttccatgcttcccatttgttcagcagttcatagccgacaggcattgcttccggttcatgctgtccgtagaatgcatcctttgactgtaccactcctgtatgccaggtgcatccatcttcttttacagcctgcaccagtgcattcgttacctccagactggcaactgccggatattcgattggtgcatattctttgcttgtcccttccatgcggattgaaccggttgcgatcacaatatcaccgctttttacttccggctgcattccaccgcaggttccgatccggacaaatgtatctgccccgcagcgtaccagttcttccattgcaattgctgccgacggtcctccgattcctgtcgatgtcacactgactttctcaccatccagcattcccgtataagtcgtaaactcccggttacttgcaaccaaaaccggattttccagatattccgctatcttttcacatcttcccgggtcccccggcatgatcacatagcgtccgacttcacctttggcaacctgaatatgatactgtctgcttgtatcttctgaataatttttcataccgatccttcctttcgagccagtggggacggggtttcccggccttttttctgtcccctctgatctttaatcttacctttattttatcacaattcaggccaaaataattttattttctgactttttaaaaacagctttcaaataacaccacgaaaaaagccaatggggacggggaaaaaaacattttccccgtccccattggcttatctgttcttcacattaaatgctgcttttccaggatatacagcacttgctccgagttcttcctcgattctcagtaactggttgtattttgcaactcgttctgatcttgaaggtgctcctgtcttgatctggcaagtattaagtgctactgcaaggtctgcaattgttgtatcttctgtctctccggaacggtgagatgagatagctgtgtagccggctttgtgagccatcttgattgcttccagtgtctctgatacagatccgatctggtttaatttgataaggatagagttaccgcatccaagttcgatgcctttggaaagtctctctgtattcgttacgaacagatcgtctccgactaactgtactttgtctccaagttcagctgtcagtttctgccatccttcccagtcttcttcgtctaatgcatcttcgatagagatgatcggatacttgtctaccagtttcttccagtgctcgatgagttcttcggaagtaaattttgtacctgccttcggaagtacatattcgccctttttctcacctttccattctgaagatgctgcatccatagcgatcataaaatcttttccaggttcgtatcccgcatcttttactgcatctaagatgtactggattgcttcttcatccgatgcaaggtctggtgcaaatccaccttcatcacctacagatgttgcaagtccttttgattttaataaagctgccaatgcatggaagacttctgcacaccagcgaagcgcttctttgaagcttggtgctcctacaggcatgatcatgaattcctgtacatctactgtattggctgcatgtgcgcctccatttaatatattcatcataggtaccggaagtctgttaccatttacaccgccgaggaaacggtaaagtggaatctccagtgcatttgctgctgcacgtgcacttgcgatcgataccgcaaggattgcatttgctcctaagttcgatttatcttttgttccgtctgctgcgatcattgctgcatcgacagcgtagatgtctgatgcgtctacgcctttcagcgcatcgttgataactgtattaatattctctacggctttggttacaccttttccgccgaaacgggatttatctccgtcacgcagttccagtgcttcgaattctcctgtagatgcgccgctcggtgccgcacctcttcctaccgttccatccagaagatatacttctgcctctaccgtcggattacctctcgaatcaataatctctcttccaataaccttctcaattgctaaaaaattctccatgtcaagatcctttcccatggaaccacttctgtctctcttgctcagtgacgagacagaaggagtctgccatgatttattcacacactagttaggtattactaactagtgttagcatatcataacatttttgggtaaatcaaggaatttttttaattaaaaatgagaaaattaaccgatagaacattgaccgaagacattttctgctttcgaatgcatggaaaaaagcggcaaccagaacctcttctgattaccgcccaaaggatatatctgtatgtcggatgtttcatttctgaaaccaagccacctgtgacagacaaaaagccacttttcacgtcccccctggctagcaaagtgcctttccaagtgcctgacaagctgccaccgcatcatcatccggtgcttcgtttgcaagtacactctcacacgcaagaacagctccgtcacctttgcatgtctcttcccatgtacgcatccattctccgtctccccatccgtaagatccgaagagtgcgatcttctttccgccaagctttccttcgcagtccgagaacatcggctcgaattcgctatcttccagttcttctgctcccatagccgggcatccgaatgctaccgcatcgtaagcatccatcttatctgcaccgaattcggaagctgttaatacatctacttctgctccggcagcctttgctccttctgctacttcgtttgccatagcctctgtgttacctgttccgctccaatatactactgcaattttactcattattttctacctctttcattgataattttatatgtcaggcagctactgtaagctgcaaaacacttcttccctgctgccagagacgtacatagacatctctgcattttttatattttgcaaatcttttccggcatgcgcactcatcacaatatactttccaacatcccacacacttgaaattgcgcccttcatttgtaataaatccgatcacatctcccagtggataatcgagaaaaattccgatttcatgtggaaattcattgttttcgccgattcttgatttcaacctgtccagtgcatattccacatccgtgcttccatatccgtattgttttaggaacttcgccactcccggccggttcagactgacctcaagctgttttttacgatagacataaaccaatacgcggttctcctgtctccgtaatatatagagacggatacctttttctttcatgcactgattccaaaactcaatctgttcttctatatccgtatcatcaacaaatgtcatattgaataaatttgctgatttcattgatgcaagtgttgccgagcaatgctccaccagacatttttcgatcagatatctgttcgccatcttagttcctcctaacgaatgttagagctatctaacattctatatttgaatactatatcattctttccagactgtcaagaattatgtgtaaaaaagaagcttgatgaaaatttatttcatcaagcttctttttattttcttatctgttattttatttttatttataaagatatttttttactcatctaaaagattctgcatactcttaagtccgatcagcagcgtcgatgtattatgtaacaatgctgaagtcgtcggcatgatcacaccacatacaccaagtgcgatcagtcccgcattgaatccaacaatcgtgtgataattatggctgatccgcttgatcaggccattactgatcttctttaaagttaccagttctcttaaattatctgcaccaacggtaatatctgcgatctctcttgcaagttctgcaccatcactgatcgcgattcctacattggctgcagaaagagccggtgaatcattgataccgtcaccgatcataataaccttacgccctgctgctttttctttatcacaaaaacttgccttatcttccggcagtacttccgcatagtattcatccacgcctacgcgttttgcaattgcttttgcggtacgttcactgtcaccggtcatcataacaatcttacttaatcccgcttcacgaagttcctttattacctctgctgcttcttcacgtaacggatcttcgatgcagatcactgctgcaagttttccttcaatcgccatatacaaatgcgaatattcttccggcagattatcaaactgttctttcttaccatctggaatgattacctcttcatcttcgaatacaaaatgatagcttccgatcactgcttttttaccttctatctgtgtggaaataccatgagctacgatatattccactttcgaatgcatttcctcatgatccagatgttttgcctttgctgcgctgacaactgcttttgccatagaatgtgggaaatgttcctccaggcatgcagcaatacggagcagttcatcttcattcatttcattgaatgataccacttttgccactgtcggttttgcttttgtcagtgttcccgtcttatcaaatacgatggtgtctgcttccgcaactgcttccagatactttccaccttttactgtaatcttatacatacctgcttcgcggatcgcagagagtacggagattggcatcgcaagttttaatgcacaggagaaatctaccatcagaatagacaatgcttttgtcgtatttcttgtaagcagccaggtaagtgctgttcctccaagagaatacggaaccagtttgtctgccagatgttctgccctgctttccagtcctgatttcaatttttcagaatcttctatcatagccgcaatcttttcgtaacgactggatccaccgacagcctttacattaattgtgacctctccttcttccacaacagttcctgcatatacataatttccaattgttcttcttaccggcacagattctcctgtcagggaagcctgattgatcattgcttctccgtccacaacttcaccgtcaaatggaattacatttcccatatggactaccacctgatcaccggctttaatcttacttgacggaacaaggacggcctggtcttctgtcttcagccatacttttccgacattcaatgacatggtccttgccagatcatcaactgatttcttatgtgtccactcttccagaagttctccgattccaagtaagaacatcacagatcccgcagtatcaaagtcacttcttaagatagagacaccgattgccgtagcatccagtacagggacttccagttttctttccatcagtgtcttaatacctttccagatatattttgcagacataatggttgtatatgctgctgagatcggatatggcagtaagaattttcttccataatggaacagaatcttatccaccagtttctcctgatactctgcattcattgctcttccggatgtctctaacaggccattcggcacttctactgcctcataacggaatctgcgaagtccttcgatgattgtttctctgtttcccttataatgaatcgttgcgtccgccgttctgtcatagacatctgcgcggaatacgccgtctatattctgcagataaaagagaagaatgtccgcctgttcatgagtcatgcgtttctgctccatgtggatacggattcttcctcttatctcatgcttaatcttaaatttcactcttgtcacctcttgctagtcttacaaaagcacctgcagatgttccgcaggtgcccgtgtattatggcaacttataatcttcgtgcccgtttttatgcttctgtagctgcttcagcttctgcagtctctgctgcttcctctgtctcttccgctacttcacaatagtcatctacaacttctgcttctgcctctgctgctctgtcttcattgatctgctttgcttctgctaaaatatctcctgcattctcctgaacgcttgttgcagtcttcatcacacaagattttgctcttaatacggctgctgtacagtttgtatataatttctttgcatcatcacttgtcaggatcttgattcctgctgttccgaaagctactcctgctgcaaaaagtcctggttttttccaattaatgtcttttaaatttaacatatgtattccctccattgtatatttattaattaaacactataaacactataacaaaaaggacatcccttcatttgtgtccggcagtcatttttgtttctgcaaattataacaccaaagaatgtccttttcaaatattttcaagctattgataaattttttcaacaacatatttatgactgcactgttatgttccgtactttctgatcttctacataaccacatgctttcagtcctgcctgtatcacagcattccaattctttgcagacagatgcttgatcgtatcatcgtccagttcaaccgtacatgcattctgcaggtcacagtccggatcacatgctactttatacatatttcttcgattgattgctccgatttcctccagcttgttgatcatccggtatacggttgctgttccgatgcttggatcgatccgagatgcgcggtaatagatttctttgcaacaggaacagttttcttccagtataatatccagaagcatcagtctctgcttggtgatcctgcatccactggcttttagtttctgtacaatcgcttcttttgccttatccacctgtcatcctcctatcgtatctactctgttatagaaacaacctgaaatcctgctttttcaactgtttttttcaaaacatcattttcaatctcacggtcataagacaccactgcttctttcttctgtaagtccactcttgccgaaacaccttctatctcatttaacgctttctttactgactgtacgcagtgctcacaggtcataccttcgatatgaactgtcttctttccgatcaccggattcttcagttctttatcgtcagttttgatgataccggttccgccgccacagcagggactatcacctttaaaatgcctgattgctcctcttaatgcaaatccaagaagaacgatcacgattaatacaactataatatctgccatatctctatccctctattctttgttctcctcattatccatgctgaacttttcgtctctttttttctcctgccatttcctgaaccagagaaatgcctgatagatagaagcaccgacaatgtaaaggacgatcacgatcacgaacaggtagaacatagagcctgtcgaattgcccatgactgccaactcccttatttaccatacatattttcgatcatttttttcacttcatcaggatctgaactgcagcatccaccaccgcatccactgcatccggcacagctgccgccacatccctggatgactccatttttaaatctcttcacaattccgtatatcaggtatgcgcaataccctaatattaatgctaaaataatgatatctgctaaaatggctaccatgaaaactgcctccttcaaagggaaatccggacgtaaatgagttacgtccggtccgctctacttatgcatttacagaacgtttagaataaactttctgatctttatacggatcaggtctgaataacaggaacagcatgactgctactaccacaaatgctactgctgtaccaactccaaatccgcctccggttactaatgtaccgatctggtatacacaaagtgtcacgagataagagaatacattctggaacagaattgcaaaccagaaccatttcttagactgcatctgctgtgccatagttgcgatagctgccagacaaggggaatctaacaggttgaataacaggaatgaaaatgctgctactgcactcgggaaccatgactggattgcctgagctactgttactgtatcttctgatttactctctgctacattagcaagtacacccattgttgaaacgattgcttcttttgctgtgaatccggaaagagaagctgctaccggctgccactctccaaatccaagtggtgcaaagattggtgcaataaatccgccgattactgcaagtaagctgtctgcactgtcgtctacaagcccgaatccgccatttgtgaatccgaatccaccaaggaaccacattactacacaagcaaggaacaggattgttccggccttgatgataaagcctttcagtctttcccatacatgaagaagaactgtcttagcctgtggaatatgatactgtggaagctccataacgaatggtgccggttttcctgagaatggttttgtcttcttcaggatgattgctgctactaatactgctacgatacctacgaagtacatgataggtgccataaatccacctgccgtgtagcttccggttgcatagcttgtcataactccacccattaatgcgataaccggtaactttgctccgcatgggatgaatgttgctgtcatgattgtcagacgtctatcattgtcctgctcaatggtcttagaagccataattccaggaataccacaaccggatgaaatcagaagtggaatgaagctcttaccagacagtccgaagtgtctgaatacacggtccataacgaatgcgatacgtaccatatatccacagtcttccaggatagaaaggaagaggaacagaattgccatctgtggtacgaatccgagtacggctccgataccgccgatgatgccatcaactaccaatccttcgattacgctgcttacgccggctgcttcaagtccttttgaagcgatatcctgaattgcacctacgaatgtatcattcgtccagtctgtaacaattgtaccgattgttgttacggaaatgtagtaaacaataaacataactgcgataaagatcggaataccaagaatacggtttgtaacgatccggtcgatcttatcggatgttgttaatttgtcttttccttttttaactgttgtctcaacgatcttctggatgaatttgtaacgttcatctgttacgatactttccatatcatcgtcatgttttgtctcaagttcttttctgtctttatcaactgctgcttttgctgctgcagaaagattcatgctttctacaaccttgctgtcgttctcaaggaatttcactgcataccatctcttcttgtcttctgagattgtatccgggagaaccccttttacgtctgcaactgctgcttccatttctttagagaagatttctcttggaagatcaacttcttttttattagccactttgattgctgtctcaaccagcgcatccagtcctgtctgtttcagggcagaagtctcaacaatcgggcagtctaacaacatagaaagtctctttgtatcgatcttgattcctctcttctccagaaggtctgtcatgttcagtgcaataaccaccggaacacctgtctcgatcagctgtgttgtaagatacaggttacgctcgatattcgttgcatctacaagatcgatgataacatccggatcatcatttaagatataatcacggctgactacttcttccagtgtatatggcgaaagagaatagatacccggaaggtctgttacgatgatgtcatcgttctttctctttccttttaattttccctcttttttctctactgtaacacctggccagttaccaacatactggttggcacccgttaaggcgttaaacattgtggttttaccacagtttgggtttcccgcaagtgcgatcttgattcccattcctatttacctccttgaacgtgtaaattctaatgcgacaatatgtatctgtcagttccttcggtaagtcttattttacctgaacacactgagcatcgtcttttcttactgaaagctcatagcctcttactgtaatctctacaggatctccaagtggagctacctttctgatatacagctcgcttccttttgtaatgcccatgtccataatacggcgcttgtatgcgctgtccccttcaatcttcgttacaacaactgtacttccaacttttgcatcacctaaagtcattgctgtttctcctttccttagattgttagtatctataatacagcagacaccccggtactaaaccatgatgtgccgcgccatatcctcatttactgccactctggagtctttgacatttacgatcacattgcctccgatcttcgacagtacaacaacttccgctcctgcaacaaatccaagatttgccagaaaacgtctcgtctcttcatttccaccaatacgtgagattgtgtttgtttcaccgataccggccattgtaagtggcataataacacctcattttctttatgtagtattttttacatctttccatgtaatttcccaaggattttgataatgataaatgttttcattatcccttgcaatagttagtatatgctaacgtttgttagctgtcaaccactttattttattttattgattattttttctcaataagttttttcttccgtttgccagtcgtaactaactatgttatactaaactcaatgttaacgtataaaggaaggaatgacttattatgagcaatgtactaaatgaatctgccgagaactatcttgaaacaattctgattttaagccagaaactgcccgtagtgcgttccgtagatattgccaatgagcttggttttaagaaatccagtgttagtgttgctatgaagaatcttcgcgaaaaggaacatattaaagtagatgaacagggatttatccatttgacaccatccggtctggagattgcaaatatgatttacgaacgccacacccttttatcatcctggctgatacatctcggcgtacctgcggatgttgctgctgccgatgcatgtaagatggagcatgtgatcagtaaagaaagtttcgaagcgatcaagagacatgtatacgagaacaaagaagtgtaaatcatccgtttcgttttattttctttttatattatgagattttattttttcactgtattctaaaggagtcttgatttatgaacgaaagtattaaaaacatgatcgaacgccgcagtgtacgcggctacaaaccggacatgatcccgaaagaagatctggatctgattcttgaagcaggcacttatgccgcaaccggcatgggaatgcagtcaccggttattgttgctgttaccgacaaggcaacccgtgatcagctttccaaaatgaatgcggatgtcatgggaactgatacagatccgttctacggagcaccggttgtcctggttgtattagctgataagaacagaccgacatatatctatgacggaagccttgttatggggaatctgatgaacgccgctgcttctcttggaatcggaagctgctggatccaccgtgcgaaagaagtcttcgcatcggaagagggaaaagtacttcttaagaaatggggcgtggaaggtgactatgaaggtatcgggcattgtgtgctcggatatcctgctgcggatattccgaaggcgaagcctcggaaagagaattatgtgtattatgtagattaaatgaataacaagaacaaaagaggaaccctggatcaatgtgatcctcgtgattcctcttttcacataccataaattatttcgtaaagttccggtgaagtaattcgtgttcttttcctttcagcaaggagtcataaagtgacaggatcatcggattttcatttgatttcttgatctgtgtattgacatctgtatcatacagccccttcattctggccctcttcgttctagggcctgcattgaccggctgtccgccgcccatgatgcagcctcttctgcatgccatcacttctacaaaatcataatgtacctcgttatttttaatccgctctattactttatctgcattggcaagtccacttacaacggcagctttgatttcccgtccgttataattatacgtcagttctttgataccttcatcaccacggacaccgcttgtcttaattgcttccatgtccacacggttatgcccctgctgtaatcttctaagaactgcttctgtcacaccgcctgtcacaccgaatatcacaccacttcctgatccaattccaaatggtacatccgctgcttcaatctctactttatcgaatacaataccggattttttgatcattcggatgatctctgtggttgtcagtacatagtctacgtcctgttttccatttgtcatagactccggacgcaggatttcttctttctttgccgtacacggcatgatcgatacggataccagtctctttccttcattcttttccggatccttatagtactcccgcactacagctccgaacatctgctgcggagatctgcaggtcgataagttttctgccagttccggatatttggtctcgcagtgtttgacccatgccggacaacaggatgtaaataacggcagcttttctcctgctgtgaatctttcgataaattcttttgactcctctattacagtaaggtctgctccgtaagatgtatcatatacttcatcgaatcccagccggtgcagaacacctaccagtttgcccatgacattttcaccctttgcatagccaaactgatcgccgactgccacacgtactgccggtgcgatctgtgcgatcaccttcgtattcttatctgccagcgcttcccataccagatcaatattcgtatgaatactgatcgcacctgtcggacagacaactctgcattgtccgcagcctacacagtttgtctctgctatcttcttattaaatgcaggtgttaccagtgcatcggttccacgataagcaaagtcaatggcattgatattctggatattgtcacacatacgtacacagtctccgcataagatacatttattcggatctcttatgatggccggagaactgttatcgatcggctgcatttccctgacattttcaaagcgcacttcgtgtacaccgagtctatgtgccagttcctgaaggtgacattccccgcttttgatacaggttgtacagtctctgcaatgtgccgcaagcagtaactccaggatcagctttctataatgcataagtctaggcgtatttgtatagatcaccattccgtctcttggtttttccgaacaggaggcaaatgtctttcctctctcattttccaccgtacacagacggcaggctccgtaaatcgataattctgagtgatagcacaatgttggaatatcaattccggcctttctgatcacagacagcacattcggttcgtccgtgaattccacgcgctgcccatcgattgtcatgattcccataatatcccctcctattccgtatagattgcaccaaatgcacagttatctttacaggtaccgcacttgatacatttctcattgtctatcacaaatggtgtcttgatcttgcctgtgatcgcattcaccgggcagtttcttgcacatttcgagcagcctttacatttttccagatcaatcttatatgtacggagatttgaacagacgcctgctttgcagtgtttctttaagatatgctcttcgtattcctctctgaacgcatggatcgtactgataaccggctttggtgcactctttccaagtccgcacagtgccgtgctttcgatcatatctgccagttcttccagttcatccagatcactcagctttccattgccctctacaatccgttccagaatttccagcatacgtttggttccttcccggcatggcacacattttccacagctttctctctgtgtaaaattcatgaagaatctggccacctctaccatacaagtgtcttcgtccataactaccaggccgcccgagccgatcattgcaccgatctttgtcagtgaatcaaaatccatcttactgtcaagctgtgactcgaccagacagcctccggacgggcctccgatctgaacggctttgaatttcttattattcttaattccgccgccgatatcaaagataatctcccggagcgtaattcccatcggtacttcgatcagtcctgtgttctttacatttcccgtcagggcaaatgcttttgttcccggactttctttcgtaccgatcctgcaaaaccagtctgcaccgtttttgatgatcatcgggacattcgcatatgtctctacgttatttaatacagtcggtttcgcccacagtccctgttctacagttctaggcggttttactctcggcattcctctctttccttcgatagatgccgtaagagccgaaccttcgccacagacaaatgctcccgcacctctgttaatatgaagatggaaactgaatccggttcccagtatattatctccgagcaggcctttctcttctgcctgttcaatcgcaatcttcagtcttctgactgccagcgggtattctgcccttacataaatgtatccctcatgtgcctgtactgcataggctgcaatcatcatgccctcgatcatacggtgcgggtcaccttccatcacacttctgtccatgaacgctcccggatctccttcatcaccgttacagacaacatatctgactttttctttctgtccagctacctgtgaccattttcttccggtcgggaatcctgcacccccacgtccccggagtccggaatctaatacgctctttataacagcctccggcgtcatctcgaacaccgctttttcaaatgattcatatgcaccggctgcaattgcttcctcgatatgttccgcatcgatatgtccacagtttttcaggaccagtcgtgtctgctcggcatagaacggaatctcttcctgtgtctcatatactttgtgatcatcatgatacatcagccgttctaccggttctccgcgcaggatcgtcttttcaaaaatttcctcgcagtcttctaattttactttcagatacaggtaattgtatggttcaattcttactaatgggcccatctcacagaatccatgacacccactcatctttactcccggatgtgcaatctcttctccgattttaaccgtgacatgatccataccttccgacatttctttaaaacgtgcataaatcttatccgatccccctgccagacatccggttccaccacataccagaatccggcacttttctttctgatgcttttccttacattcttctctccacagctgaagctgtaatctgttctctattctcatacctgttcttcacctcgcagctttccgatcagttcgctcatcttctccggtgtcatctttggatggacctcgtcatttaccataactgccggcgcaagtccgcatgcgcccaggcatgataccgtctctacggtaaataactgatcatctgtcgtgtgctttttctttccaagcccaagttctttgtacaggctttccaggatcggcacggattttcttacatgacaggccgttccgtcacataccttaatgacatactttccttttgcttcaaatgagaaattctcataaaagctcgctacactgtacgcttttgcttccgaaatccccagctttccggcaacatatgtcaaaagttccggcggaagataacggtattcttcctgaattccctgaatgatcggtatcagagacctctctccacagctgtactgtgcgataatttcatccgctttttcgtagtatgatgcatctaacatccatattcctcctatttgtgtattttgtattggttttagtatatcactaatgtttttttgtgcatagtgcctgcatacatatttttgacaatgtatgattttatacagagaacttgccactggcaacttctcttgcatactttggtatgcaaaaaagccgtgacattcatcacgacttttttctcacaaaccatttttctgattctttattttttattatgtattatcttatgcgtccttccatacttcttcagcgatctcttttaccagttttaattttgcccactgctcttcttctgtcagtttattaccgatttcgcaggatgcaaatccacactgcgggcttaaatacaatctctcaagcggaatatacttttctgcttcatggattcttttgatcacggtttctttgtcttcaagttccggtgacttagttgtgaccagtcccagaacgactttcttatcctctaaaacttttgcaagcggtgcaaatcctcctgatcttgcatcatcatattccaggaataatgcgtctacattttcctttgcaaatacatagtctgctacggaatcatatggaccacttgtaaagaatgttgagtgatagttacctctacagatatgtgaagtgatcaccatatctgccggttttccttctaatgcaaggttatttacttccagcagctgtccttttacttcgtccagatcctgtccaagattcttatatctctgttttgcagcatcacctacaattgctccccatgtacagtcatccagctgcaggttgcggcatccggcctcataaaactgcttaatgacttcctgataagcctttccgatatcccggatcagttcttcattagttgcatagtattttcttgtattctcaaagtttgccggaacgatcatctgctggaacatctgtgccggtgccggaattgtatattttgcgaccgtattctcgtcttcgaactgtttcaggaatttgaacccttctacaaacggatgtgcctttgcctttacttttccggtcagataagtgtcttccagcgctgccatctccgcattgaactgtacacccgctcctgtctgttcgtggccaacaccttcaaatccccacatgaagtccaggtgccagtaagttcttctgaattctccatctgtaatgatgtggaatcccaactctttctgctttgcgactacttctgtaactgccttatcaacgacagcatcacattcttcttttgtgatctttccttcactgtaatctgcttttgcctgttttacttcctgtggtcttaaaaaacttcccacaaaatcatatctgtatggtgtctggtatttactcattttctatatcctcctgtgattatgttcctgttgtttttgtctggatatagagtagcataattcggaggatttggataatacatatagcttgcgatttgctatagtttcaaattatggcagtttctattgcatactttagtatcaaaaaaaatacagtacccatatcagatactgtatcattcaatcggagtgacgtgattcgaacacgcgacctctacgtcccgaacgtagcgctctaccaagctgagccacactccgatatatacaatttttaaaagtaaccggacaccttctaaaaagtatccggcgcccctgccaaggaactacggatagaggactcgaacctctactaacagagtcagagtctgctgtgctgccattacaccaatccgcatcagtgtgatgttctgcattgttcagcgaacaaatattattataccaattttttcaaaaaagtcaataggtatttttgatttttttctataacgaaaaaccggatacttcttaatgaagtacccggcatcataactacggatagaggactcgaacctctactaacagagtcagagtctgctgtgctgccattacaccaatccgcatcaataagacttttctctgctgtccttaagttgtccagcaaatattaattatactcgtttgcagagaaaagtcaatagatattttaaaaaaaattatttttttctgtaccactgatataacccggctgataacaccagacagcagctctccgcaatcagcggtgcccaccagatagcttctcctccaaacacagctgtcagaaataccagactgatcaccagtgcgatcagacttctagtaagtgagatcatcgttgcgaatccagccttttccacagaggtaaaatatcctcccaggaccacattgagtcccgcaagcagaaatgacaggataaagatgcggagcacccgcaccgaatatatactcagagatgcttcactctcttttaagaacaatcccacaatactttctgctccaacataacatatgagtacagccgccacggaacctgccgcagctgccaccattccatacttcagaagcttcttatacttttccgattcgttttttccatagtagtaactgatcagtggctgggttccctgcgcaatgcctgccatggacatgacaacgatcgtattcacatatgagatgatcgtataacttaccaatgcatattctcctatatatttcaggattgcctggttaaaaaagaagatgataatcccacttgagaattctgttatcccggaagacatgccgttacggatctgcctcccgatttccgatggcatcagatggaacttcgagaatcttattgttcctttcggtcccagaaaatgccacagatacaagaggatcactgctgcctgcgagatcccggtagcaaatgccgcaccccagacgcctttatgcagcaccatgaccagaatataatccaggatacagttcagcacagccccggatgtcacatagattgtcgcaagctttggatagccatctgtcttgatcaacgtctcaaatgaataagataggatatatactacagaaaatggtgcgatcgttccaatatatgttctcgcatatggaagaatatgatccgttgctccaaggaatcttgcaaatggatccagaaatatcataaccagtattgtaatcaacaccgacaggatacataataagaccacattctgcgtaaagacttcgttcgccttctgtttttccccctgtcccagaaagattgccacaatcgtcgaatttccaactgcaaacagaatggagacagaaaacagtcctgttgtaaacggcatggagatattcaccgctgtcagtgccacttccgatacccctcttgccacaaagataccatctaccatggtataaagcgagaatacccactgggcgataattgacgggatgataaaacgcaaaaaatcactcttcaaagactttccttcgagtctcatattaaaacctcatttcttttacctgtttttctttcattcatagtctaaaccctggtataatactaaggtcaagtattatgtatcaacagaattttgttttcaacaggtgaatatatgaaacagttttttaagatcaacgaaatatccaaactatacaacatcggaccggattctctccgctattatgagaagctgggacttctggctccaaaacgcggaaaaaataattaccggctctatacgcttgatgatctgtggcgtctgaatatcatacgtgatctgagacgtctgggatttcctatggaaaaaatccgggaatacatggacaatcgaagcgttgagaacacgcgtaagctgctcacagaagaactggatgtcatccatcagcagattcaggaattaaaccgtcttcagaaaaatgtagaagaacggcttctgacattatccggtgcggaagaccaggcactgcttaaaatccgtctgcagacgtttcccgaccgttattgccataccttgcatattccctaccacacagacgaagaaatggatcttctggtaaaacagttgttgaataaaaatacagaaaatctttatattatcagcaaccataacatcggatcttttcttccgttagaagaaataaagaaaggacagtatgaaaattattctggagtgtttatcattgataattcgggagagtattgtctccgcggcggtacttatattaccttcacctatgcaggtgattaccgccagaacaccacttatattccggaacttctcaactatgcagatggtcatggtcttgtccctgatggacctattctggaactgatctgggtagacaatcatcaatctgcagatatccgcgaacatattacagaactacagataagagtatatccaaaatcctgaccgcatctctctgcatttgttgtgacgccatctgcggaacacatatgccaaacacatagcgataaaaaaccggtattcccgtgcttttttcagcataggaataccggccgtttttttattacatcttcttaattctctcaatcgctgcaactgtactctcataggttccaaatgcagtcaggcggaaatatccttctccacttggtccgaatcctgatccaggagtacctactacattagccttatcaagcagataatcgaagaaatcccatgatgtcattccctttggtgtctcaagccagatatatggtgcattgacaccgcctgatacattgtatccggcatctctgagtccttctttgattactttggcattgttcatgtaataagcaacctgtgcacttaactgttcttttcccgcatcagaatatacagcctctcctgctttctggatgatataagaagttccattgaactttgttccgtgacgtcttgcccacagagaatgtaacataacatctcctgacttgatatcttttggaattactgttgcactcagacgtactcctgtaaatccagcattcttagaaaaacttctgatctcgatcgcacatgttcttgcgccctcgcactcatagatagaatgcggcacttctttttctgaaatatatgcttcgtaagcagcatcatagatgatcactgcgcctattttatttgcataatcaacccatgtctgaagctgttcttttgttaccgtagatcctgttgggttgttcgggaaacacagataaatgatgtccggtgtctcttttggaagctccggtgcaaagttcgtctcttttgtacaaggcatatagatgacattgctccatgttcctgctgcagcatcatatgtacctgtacgtcctgccataacgtttgtatctacataaaccggatatactgggtcgcacacagcgatcttgctgtctttcgagaaaatctcctgaatattaccgcagtcttcttttgccccgtcggaaatgaagatctcatccgctttgatgtcgcatccttttgcctgataatcattcttcgccattgcgcttcttaagaactcatatccaagatccggtgcatatccatgaaatgtctctgcatgtgccatctcatcaactgccccgtgaagagcctcaacaattgcaggtgccagaggctgtgttacatcgccgatactcagcttaatgatctcggcttccggatgtgctgcctgatattcacgctgttttcttgctactgttgagaacagatagcttcctggtaacttcaaataatcctggtttactttaaacatcttcttactcctttatctctgtaatgtctatcacgccgtcgaatacaactgttgcaggtcctgtcataaatacacgatccttttctctgtcccattcgatctgcaagtctccacctaataattttaccgtaacttgtgtatctgtcaagttatttaatatactagagacagctacggcacatgctccggttccacatgcaagggtttcacccgagccgcgttcccacacacgcatctctaccgtctgtctgtcgatacagtgcacaaactctgtattaatacgcttcggaaatctttcatgattctcgaactttggtccgattttttccagatccagtccctttacatcatccacatagataactgcatgcggatttcccatagatactcctgtcatatggtactcttttccatccacctcaattggttcgtcgatcacctgttcccgctctgatatgattggaatcagatcagcctcaagttccggttttcccatatctacttttaccagtgacactttcccgtcttctacggtaagatccagatattttattcctccaagtgtttccacggaaatctgtgtcttatcggtcagcccgtaatcatagacatatttcgccacacaacggattccgttgccgcacatctcgcctcgggaaccatctgcattgtacatctccatctcgaaatcagctgtttttgacggattgatcataatcagtccgtcagaaccaataccgaaatgtctgtcactgacgaatcttgccaccgccggcggattgtcaatcttttcttcaaaacagttgacgtagacataatcattgccaagtccatgcatctttgtaaatttcatctgttctttcttcctgcctttcctgcatccgttttctctataatatgtttactctttcatctcttactctgccataatgctcagtaccatctctgctgtctctaccatattcgttccactgtccatactgctcttctgaagatagcggtgtgcttctccttcagacatattattacgttccatcaggagttcctttgctctgcggatcgtctcttgctgctttggatcacgattctttgattctttcttccgtttttttcgttttctgtccatggactgaagcatcatgttcatggtattcataaggtcgtataccttgatcggggtagaaagccctacaattccttctacatccccgctgctccatttatcctgcgatgcgatcaggagcatttcaaatgaatccggtaaatattcccgcagctgtgtatacatcatatctttcatgcggtaaccgcagaccacgatcccgttatccacggtatctgcatagtgcatagcctgtgcaccggtggaacacacgccaattacatccataccgcccctggcaagcagatttctgatatttgttgcattatctttattcgggaatacaacaataatccctgtcactctgccacctcctgtcagatactcttttgcgcgtttctgttaagtgcaaaatcgtattacagtaagtgcagatatttttcaagctcccagtctgtaatctggattctatactcataatactcactggtctttgcttcgatgtattttctagaaagatcttcccctaatatctcctggataaaggtatccttttggaattctattgctgcctctctcagacttcccggcagtttctcaattccaaagatcttacgttcttcatccgtcatctcatatacgttgcggttgactgctttcggaggcatcaagccctgtttgatcccgtcaagacccgccgcaagacataccgccaacgccaaataaggattcgctgaaggatccggattacgaagttctactcttgtatactctccgcgacttcccggaatccggatcagtggtgtacggttctttgcagaccatgcgatgtataccggtgcctcatatcccggaatcagacgtttgtaggaattgatacttggattcgtgataaatgtcagcgctttcatatgtttcatgattccgccgataaagcaatatgcttctttactgagtccatactcatccttcgcatcctggaatacattgattccatccctgctgatcgacatattcagatgcataccggaaccattgataccgaacttcggctttggcataaatgtcgcatgtaatccatggcgcttggcaatcgtctttacaaccagcttgaatgtcataatattatctgcagttgtcagcgcctcatcataacggaaatctatttcgtgctgtgccggtgccgcctcgtgatgtgaagattcgatctcgaatcccatatcctccagcgtcagaaccatatcacgtcttgcattctcgcccagatctaaaggcccaaggtcaaagtatccggcactttcatgagaaagcgtagtcggaagtccgtcgtcatctgtatggaataaaaagaactccagctccggtcccacattgaattcataccccatctcttttgcttcggccatgacctttttcagaatatatctcggatcactttcatatggcgttccatccggtttatagacatcacagatcagtcttgcaacctttccctgctgcggtctccacggaaatatctcaaatgtattcagatttggatacagatacatatccgactcttccactcttgcaaatccttcaatagacgaaccgtcaaacataatttcattattcagagctttgtctaactgacttgtggtaattgcaatgtttttcatggttccgaaaatgtctgtaaactgcagacggataaatcctacatcctcttcttctaccattcttaatatatcttctcttgtataattattcattctactgacctccactcgatatacatcttttatgtgtcatgacttcttacattgcatcaataatctgctgtgcaaatgcatccaggttttcttcctgatctgcttttaatgtcgatttaacagataacttctgatcgagtactgtcatatttttcatctcttctaactgttttacgatctgcttccctgctgtggcagcccaggttccgttatccataaccgcaactgttctgttctgcaccgccagtgctttcatatgtgcaagcagattttcaatcggtgggtagatacctccattgtatgtcgggcatgcaattaccagatggcttacccggaagatttctgcgatcagttccgacacatctgtttttgatgcatcgtaaactgcaatatttttcacgccttttgcaccaagctttgctgccagcgcatcagctgcctgctctgtattgccgtaaatcgagccatagataatggcaactgcctgctcttccggctcatacttactccacttgtcatgtttctcgataaagtaattcagattgcttctccataccggtccatgaagcgaacagatcatctggatatccagcccagctgctttcttcagaagtgtctgtacctgcataccgtattttccgacgatattggtaaaatatcttcttgcatcatcgatccagtctttttcaaagtccacgtcatcattgaacaggttaccgttcagagccccgaatgttccgaatgcatccgcagaaaacagtatcttctccgaagcttcgtaagagaccataacctccggccagtgtaccatcggtgccattacaaaatgaagtgtatggcttccaagttccagtgtatctccttcttttactacaatcttcctgtcttccaaatctacatcgaaaaactgtccgatcatctgcatggtcttcgcatttccgactacttttgcttccggatataattccaggattttctggatattggcacagtgatctggttccatgtgctgtacaaccagataatctaagctttctccgtttaatgcataagccacattttcgataaactgcctggatgcagatgcatctacagtatccatcagagtattcttctcgtctttaattagataagcattataagatacccctctcggaatcggaaataaattctcgaataaatttaatcttctgtcgtttgctcctacccagatgatatgatttgttacatttcttgtacattgcatgattgattcctcctgtcagtttcctgtttttattttttaatgattcaggctttcttttcctgatgatagattacataggtattccgtccctgtctcttagcctcatataacgcctcatccgcataatgatacaattcatcaaaattcattccatgatccggataatatgcggctcctatactacaatggattgctccacacggaatacttcctattttaagattttcaaatttatggcataattcctgcaactgacgttctatgactttatcccatctgacatttttcatcagaaccataaattcatccccggctgcacggcctacaatgtcactggatctgaatgtatccttcagtacttttgccgcagccttaataacttcatcccccagtgcatgaccatatgtatcattaatatttttaaattgatccagatccagcataaggagtgcctggataccttctttttctccatgttgcagccagtcattgatctgatactggatactgcttttattcagtatattggtcatcgagtccatctgtgcacgatttatcagatctgtttgtttcttctgattcagcttccacaaaaccagcagcatgatcagcacaccaacgatcacagcaccgagcagtctatactcataaacagtgataaaagaatactcctccgacgcaacagacacaggcaccgtataacacaacatccactgattataccctaatgattcatatgcgatataataagcctgcttcttatattttacttttatacagttttttctgtgaaatttgaaatcttgtcttgccgattccagtctttctctgtttctgccggattttccctgatagatctcaaataaattctcatcctgcaaacatttgattgcatcggattctactgctattattttgccctcccaggttgtgatcatcggatagccttttccctggtatacatcttcaaacaatatctggcttaactttaccatatcaaaagaacctgccacagcaccaataatctcaccattctttttgatcgggactgataacacgactcttcgttttccatccagcgaactgtataagggatcacttaacacttcttcacttttcatggttcttttaaagtaatctctatctgcaactttctgttcttttccatcattcgtaactccatttccatctgtgtcaataatagaaatagcatggaataatgtatcctgcgtcatgcaggacagaagttcctgatttttctcacacatcagactgtcttcttttgccacataatctgctatattactcaaatatataaactgcgtgttcagcatgaatttcaactggctttgttgatgatctgtattgtagtccagcaattcttccacattctgttcggttctcacctgcacattataagaaaacaccaacaaactcacagcaagccctgcaatgaatacgagcagcacacgcatatactcccaaaaagaatactgctttaacctcttcatccgtttactccttttatctatacgcttcccgtcacataatatcatatttttcagcacattaacgcacaaacttttaaagtttacgcattaaatttcatacaatattataatacattcatttctgattataatttcagtatagcataattctaataacgttttccacttattatattctttctgatgtctccgttttgtatttttatggtacaatgaacatattatatcttatattttatatcgcagacatttgcagaaaggagttcttttgaaacataccgcaccgccaactacacttgagtccaggacattatggcacaatatcgtatctaccataatcatactagccattgcaaccatactggcattttctttttttcatatcacgcaaagtgaccctgccaatatcgcattgatctatattcttgcactgatcataatcgcaaggatcactaccggctattttttcggaattatttctgcttttttttgcgtgatatttatcaactggtgttttacctacccatattttaaagtaagttttgcaatcagcggatatcctgtaacatttgtatttcttcttaccatctccatgatcgtctctaccctgactacacgattaaaaaagcaggataaaatgatccttgaccgggagcgtgcgatcaatgaagccgacaaagaacgtatccgtgccaatcttctgcgggctatttcacatgatctgcgcacaccccttacatccatcatcggatcttctgattcttttactgagaattatgcagccctttctgatcaggaaaagttagatctcgtctcctccattaacgaggattcacactggcttttgaacatggtagaaaatctgttgtccattacccggatccagggagataccggaagagtccgaaaagaagatgaactggtagaagaagtagtagctgaagcgatcacccgtataaaaaagcggattccggatattgagattcacgtaactgcgcccgataacatactgatcattccaatggatcctctgctgattgagcaggtgcttatgaaccttatggaaaatgcttttgtccattccgaaactaaccggccggttgagttgcaaatatcagaagaatctgataccattacattccatgtcattgattacggaaagggaattgatgaacagacccttcctctgatattaaaaggggaatatcatgttcccaaaacatcggatacacaccgtggtatgggaatcggcctctccatctgtaatacgatcgtccaggctcatggcggacagattgccgctcataaccatgcacatggtgcggaatttttattcacactaccgaaaggggatatttaattatgactgacagttattccattctgattatagaagatgaaaaaaacatactggattttatggcaaaaactttaagatccaatggttacaaaaccatcacctccgaaaccggacaatccggactttctatcatcaactcccactgcccggatcttatcctcctggatctcggtctcccggatatggatggcaatgacatcatttcatccgtccggaaatggacaagctgtccgatcatcgtaatctctgcaagagccggagaacaggataaagttgccgctttggatctcggtgccgatgattacattacaaaacctttcggtacgtccgaactactggcacgtatccgtacttctctgcgtcacagtaaccgtatggcttccaattctcctctttttatccggccatacaaatgtcagggactgatgctggattttgaaaaacgtatagttactctggatgggaaagaaatacatctgactccggtcgaatacaagattgtagcctatctttcaaagaactccggaaaggttatgacctatgcttctgtcatggaaaatgtatggggaccgttcacggatagcaacaatcgtatcctgcgcgtaaacatggcgaatatccggcggaagattgaacgcaatccatcccagccacagttcttattcaccgaggtcggtgtcggctaccggatgtgtgaagatgaaaatgagatgtaagctgcggactctgcaccgttaagaaggtgttaaggaatcttcacatatctgtacattcagatcagatatgttattatagaagtgaagtggcatatcgtaaaagaaaagcctcattcattattctctcaaaaaaaggatgcacgtgcatgcatccttttttgttagttttttcttctgttttaatttgaatgaagcttctgaaagaatcttacattttacacatgccagatatctctgttgtactctgcgatcgtacggtctgatgagaagaatcctgctttggcaatgttcacgatcatcttcttcgcccatgacatacggtcttcgtaatctgcaaatactctttcttttgtctgaacataatcctttacatccaaaagtgtcataaaccagtctttctgaatcagttctgcatgaatctcaagaagtgtacgtacatcaccgatcctcatcatctcagggctgatgatgaaatctacccacttgcggatatctgcatcattgatatagtaatctgctgccacatagtctgattttgcatagtgctcaattacctgatcactgctctcaccaaagatatagatattctcatctccgacaagctgatggatctctacgtttgcaccgtcttctgttccgagtgttactgcaccgttcaacataaacttcatgttacctgttccacttgcttcctttgatgccagtgaaatctgttcagatacttcacatgcaggaatcaatttttctgccattgttacgttgtagttctctaccattacaacctgcagatatggtgccacttccggatcattcttgatcagttcctgcagacacaggattacatgaatgatgtcttttgcaataatgtatgcaggcgctgccttggcaccgaagatcattgtgatcggtctctttggtttatttccggctttaatatccagatatttgtaaataatatacaggacgttcatctgctgtctcttgtactcgtgaagacgtttgatctgaatatcaaagattgcattatcatttaatactactccggattctttttccagatattctttcaatgcagtcttattctgctgtttaacatccagaagtgcgttcagagcttcttcattgtcaatctgtgcaagaagtccttccagctttgaagcatctttacggaattccccgactccatatttatccatccattctaccagtttcttatcacagtgcatcagccatcttctaaatgtgataccatttgtcttattattgaatttctccggataaatatcatagaacggctttaattctacatctttcaatatttctgtatgcagtgccgcaacaccgttaacactgaatccataatgcatatccattctcgccatatgcacgcggttccactcgtcgatgatctgtacatctttgttattatattttgccgctactcttgccgccagttcacgaatgatcggcattaagtgtggaacaactgcctccagataatcaaccggccatttctccagtgcttctgcaaggatggtatggttggtatatgcacaggtgtttgtcacaatctcaattgctttatccatagagattcctcttgctgtcagaagacggatcaactccggaattaccatagaaggatgtgtatcattaatctggatcactacatgtttatcgagttcttccagtgcatatcctttttcttcacattccttcaatatgaactgtgcaccattactaaccatgaagtactgctgatagattctgagcagttctccctgtttgtcactgtcatccggatagaggaacagtgtcagattctcgcggatatcatttttgtcaaatgcgattccatctcctacgatattctcatttacagattcaatgtcgaataaatggagcttatttgttccgttttcatatccggttacatcaatatcatataatttagaatgcaggctgaaatctttgaacggtacatcgaatccgattcctgtatcagtaagccagcttgtattctggatccatgggtttggagtctctttctgtttgtgattttcaaatacctgtttgaacagtccaagatgatagttaagcccgattccgtctccttccagaccaagtgttgcaatggaatccaggaagcaggctgccagtcttccaagtcctccgttacccagtgacggttccggctctacttcttcaatctcacagatatcctttccatttgctgcgagaagttctcttacttcatcgtataccccaaggttgatcaggttattggataacagttttccgatcaggaattctgctgatatataatatactttccttccgatttccgaaatatttcttcctttatctgccgcagcttcttttactgttgaaagaagtgctgcgtagatctcttcatttgccgcatctttgattgatttaccaagtgtctgctgtaatttttctgagaaattcataattaacctcctgaatctgcgctgccgcatcattatcccgaatctgtgtctgattcatttctataaattctttgtttatcagtttccgtttgctttacactgatattataatcagattataaccataatctcttgcatcatagtagtaaaaagtaatacaatactatcaaataaacaactttttgacagtagaaaggactccagtttctgattatgaacacactcacctacgaaaacctccacgaagtaaaaaaacacgtcagcacccagttcccatacaacacctatctgtgctccattccattggacttcacacaggttccgcttcactggcataatgacgtagagatcattgtaataaaaaaaggctgtggtatcatttccgttgataccgagcccagagctgtgaaagccggcgacatcatcctggtccgcccggggcagcttcactccatttcccagcatgaaaaagacagtatggaatatgaaaatatcctgtttcagagtagtcttttatattctgctgattccgatccccggacagtcggatatttccagccgtattttacactggaatataaacttccatggctctttgacgatacctgttcctcccatgaagagctttcttcctgtattgatgcaatcgatgacctctgcgctaagcgtccggactattatgaattatcagtaaaaggacatctctttcacttcttttacctgttattctcctcccagggatcacctgtcactttcagccgcagcaaatctctggataaggtaaaacagattgtttcctacattgaatcacattatacagaaccgattaccgttcaaagcgcagcagactatatgggattctccgaatcacattttatgaaattctttaagcagcacctgcacacaacgttcaccagttatctgaatagctaccgtcttaccattgccgccagacttctgctcacggaagatgacagtattctgtccatctcggaacgcacaggattcaataacctgtcttattttaaccgtttattcaaaaaagaatatcagatgccaccgagagaataccggaaccgttagtaaacaaaaaaagaacagcgtctgagatatttccctctcaggttctgttctttttttatttttataagataaacttacctctttcttacttatatgctcttatgcaaatcctactcaacctcttccggttccatgcttctcatatgttccccgtcttttttgatctcatatttctgattatattcattcagataagttttatattcagtgctgtcggaaggatataccttcgaatcatgaatatgtgtatccatattctctttatcgctgttcataagtgcaaccatcgcacttgcacagtgtgccgcaatacggttaaagctattcaggatatctgtaaatactgttccttcttccagaccgcatccaccactgctcatacgctccacatgacgcatcttcagttcatcacacagtgttgtaatgaccataccaagcggtgctactctctgtgccatctctttatcattctcaaggaacgctttgcatgtaagattgatctcctcacgtaccgcttccatgacaacattcagttcatcccaggcatcttctgagaactgtgtcttattctcatgcatatcactggacatatatgcaatataagaagcatgatctccgatacgttcaaagtcattgatcgtatgcagataaagtgaaacctgccttgtctgtgctgtgttcatctcatgctttgtaagcttaatcagataatcgcccagacggctttcatacttatcgatcagatcttcctttttctgaaccttgtcgaacttactctgctggtactcattcagaagattcattgcacggttaacattcttacgaagcttcttcgccataccgctcattgctctgtggcactgaccgatcgcaagtgccggatacgcaagaagacgctcttccagaagatcaaagtctgcttcatcttccagttcttctgcgctgtcttttaccagccagcataccagcttctcaagtttattaataaacggaaacagaatacataccgttaccagacggaacacggtgttcaacagggcaatcgataccggcgacataatattgtccagaaaatcaaaatggacaaatgcattgatcgtatagaatccgatcgaccagatcaacattccgaaggtatcatttaataaatacacaagtgcggttctcttaccattcttatttgctccgatcgctgagaccagtaccggacaggatgctcctacaccgataccaagaataatcggaaatgcactggaaaatgtaaggattcctgttaccgataaagcctgcaatacaccaacggtagcagatgcgctctgcaggacggccgtaaatgcaatacctaccaggatacctgcgattggattcgagaacatcgtcagcatatcaataaatactttactctctcttaatggtgtaaccgcaccactcattgtctgcatgcctgtcatcagaattgcaaaaccaagcatgatattaccgatgttcttgtgtgtcgttcttttacagatcatccgcatgatcgtaccaattaccgccacgacagccgctatcgttgcagaagataaaatctttgcaataccattcgatccgtcaatataggaaagacataagatccatccggtgatactggtaccgatattggctcccatgatgataccgatcgcctgtttcagtttcatcataccggagttaacaaaaccgatgaccataacggttgttgcggaagatgactgaatgacactggtcactcctgttccaagtgctactcctttgagcggtgtgtttgtcattttgtaaaggaatgcttccagtttattaccggcaacctgtttcagcccatctcccataagggacattccgaacagaaacaaagcaactccacttaacaatgacaataccatagaaaatatttccataattttctcctttgttgtcagcttattttacgcttacttaacattcttttaaaatattcttaaccttttcttttttattatgtcacgttaaacgtttgattacaatcgtatatttgtcagaaatcacattttttcacatcccgtagaaaaacgaatcccgtcaattcctcttttttcatcaatttatccaaaaattacgttctgattttataattcttaccttgcactcagactgagaataagctatcattttgtctatatgggtaaatgtttatacggaggaatatatttgtgagaaaaaaggaacaggaacacctgatacagaccgtctatccgggttctattgctgaagaactggaaatcgaacccggcgatgtactgttaaaaataaacggacagaaaattgaggatgtctttgattatcgttatctgatgaaagatgaatatgtcgaagtcctgatccgcaagccttccggggaagaatggcttttggaaattgataaagagtacgacgatgaacttggagttgaattcgagaatggactgatgagtgaataccgctcctgcagtaataaatgtatgttctgcttcatcgaccagatgcctccgggcatgcgtgagactctgtattttaaggatgatgactcccgtctttcatttctgcagggaaattatatcaccatgacaaatatgaagcaggcagatattgaccgcatcatccatatgcagctcgcaccgatcaatatctctgtacagacaaccaatccggagctccgctgtaagatgctgcataaccggtttgccggagaaaagctaaaatttctgcaggatctgtatgaagcacatattgagatgaacggtcagatcgtattatgtaaaggcgtaaatgacaaagatgaattaaaacgttccattgaggatctttccagctatcttccttttatgagaagtgtatccgttgtacctgccggacttacaaaataccgtgaaggtctctatccgctggaactcttttcaaaagaagaagccggtgaagtcattgatatgattgaaagctatcagccaaaattctatgaagaatatggtctgcacttcatacaggcaagtgatgaatggtatattcttgccgaacgtgattttccggaagaagaacgctatgatggatatatccagctggaaaacggagttggcatgatgcgtcttttaaagacagaattccatgacgctctggaagctctgaagcagaatgacaactatgagacctggaaaaatgagacctgccgtacacttaccattgcaacaggaaagcttgcctacagtacccttgccggattcgcagaggagatcatgaaagcatttccatatattaagatcaatgtatttgcaatccgcaatgatttctttggcgagactgttaccgtatccggtctgatcaccggtcaggatctcaaagcccagcttctggaaaagaaagcctccggcaccgatcttggtgacacccttcttatcacatgcaatatgttaagaagcggagaacaggtatttctggatgatatgacggtacaggaactggaagatgcattagatatgactctggtcgccgtagaaaaccagggacaggaacttatcgaagccatgctcaatcatcactatacaatgcagcgtgacaatgatacagacagctttgtatacgtaaaaggttataactcatagcacaaacgaaaacatactttcattagcaggattaaatttttcagacaacaccaacaaagaaaaaataccgcagccttttcaaaatttgaaagctgcggtattttttccattatgcaggatttacatgaatcataatatgctttgtattcggaaacttcttttctacattgtcgtgcacatcctctgcaattgcatgcgcatctttcaacgaaagtgttccatctactgcaatctctgcatcgatatacaccttgttgccgaacattctcgttcttaacagatccagtctttctactccccggctctttctgatatagtctgccagtttctcttcatattcttcactgcatgaagtatccagcatcttatccagtgcatctttgaaaatatcaaatgctactttcaggataaaaatacagataactacacttgccagcggatccagcacaggaaatccaagcattgcaccacctataccaatcagtgaaccaacggaagaaaatgcatctgatctgtgatgccatgcatctgccatgaatgctgcggaatccagaatcttcgcataatgtctggtataccagaacatcccctcttttgtaagaatcgacacgatagctgccacaagtgcgatcgttcccggtgcctgcaaatgactgtaatcaccggctatgatcgtcttcacaccactcattccaattccaatacccgttgcaagaagaatggctgcaagcaccatcgatgctacacattccaatctgtcatgaccgtatggatgttcgctgtccgccgatttcttagataattttaccccgagaaatgcaatgaatgtggcaaacacatccgataatgaatgaaccgcatcggatatcatggctcccgaatgtccgataattcctgccagcagtttgaacgctgtcagaatgacatttccaagaattcccacggttgataaatgattgatcattttctgttcatttaattgttgtttttgacttgtcataagataacctccatttttaataatgtcatgtctcctatggcacctaaggtgagactactgttcctccgtattctatttacaaaactgcttttttgcaaaaaaatacacctgtggaactttctacttactgtcccacagatgtatgatatatcgtctcatctgctgccggtaatcgaccggcccggcatgcacatcatttttctcgattttattcttataaaaaatgaatgtagcctgatcagtttgtactgttatcccttatccgtattggatatattcagtgcaaagagattttatatataatattcgattttagcgaaaaagtcaactgctttttcaggttttcatttcagtaaaaaataataattttctgatctgcttgaatctatttatcagatatgctatatttaagacacaagagggaaaccgcaagcggctacccgagtataattgttaactatttatatagtcgtcaactattcgcagtagttggcggctatcttcgttttcccttgaaaatctcataacaaagacttacaagggcaacaatgaatatacaaaactgaatcatgtcagaatatgtaaccatcgcatcgccctcctttctttcgtctggagggtgtttttatccctccaaagttggagggtagccgcctgcttttggtttccctgtccgtatcatatcacagcgtcattaaataatcaactatattaattctattagtatagtttcatctagtcctgcagcgttttcagattatttataacctcttaagttcttcttaagatttttccgatttctttaaggaatttaacatactttagacatatttgttttttataataaactcagatagttgagagagacaaaatcaactatctccccctcataaagtagcacaccgggaatccggtgcaacactttactctcattcctttagataactataaaacaacgaagcccgttagcccttgtggttagcgggttttcgctgttctgtacttgttgcaaaatccgcttcggtcaaatctcggtcaaataattttctaaagaaatgttgcaccttttctattctctttcttattcttgttctgattatatgatttccttatacaaattctgtaatttatccatttccgattttgctttatcatctgtgacgtgcgtatacaaatccagtgtgattgctatggaataatgtccgaggaatccttgtactacctttgcgtcaatcccggcttcaaaacaacgcgttgcaaaagtatgacgaagtgcatgtggataaaaatgcggaatcggtataaacactgtcttgtttttctctgcctgcttttttcgttccttattgatagatttttctatccagtctaacgtcacttgaaaggtgtgttctgtaatcggttttccgttctttccaacaaacacaagattttcaaatccctctaatggttgccattcactagctgacaactgcatttctttcaactgaatccactgacgttttaaagccttatacacactgtcctgcatgggaatcgtccgtatactgttctttgtctttggtgtctggtacttgaatacatacttctttgtttccttatctttgatatacaccaacgttttatttacagaaatttcccgtttccgaaaatctacatcatcccatgtaagcccaagcagttctccgccacgcattcccgttccgagtgctacctgtatgagattctcgtgtattctctcctttgcgtgttccaatacttcccgttgttctttcacagtcagtacccgtatctgttttgtctttgttttgggaacttccactcctgcacatgggttgaatgtaagaatcctgttatgcactgcatatttgaacatagcattgagaatattatacacatcccgtatagtctttgtgctgtaatcatcatctgccatattctgaagcagacgttccaaaataatcggattaaaatctgccacacgttgttttcctatctgcttctttatgtaacgtctgtaaaaatcatcataacgtacttgtgtactctccttgatagtccgcttcttatgggtattcagccagatatcaaaccatgtatccagagtgatattatcgccctttcctttcaacccatgcttgacttcatagcgtaaatcttccatttcttgaactaacttttttaagtccgcattatcttttgtatacgtttctcctttgtaataaaaccgccctctgtaaattccgctttttctctgcataattcccggcggtaatggatttccttttaagtccttgcccaatctgcacgctcctttccgtgcaaggactatcagaactggtctgacagtattatatgcttatttgtgtttatactgcaattacttcatatttatttttcagattatgcccttcgtttttcttcaaaaactggtctaaaacctcagagcgtataagaatcttatttccaatccttatgaccggaatcttctgccatgtaatcagctttcgcagattatttcttccaattcccgtatactctgacgcttcattcactgtaagggctttctttgtctgtatcgttttctgtgtatgttctgtcaaagattctcctttcttcttccctcaaaaggaaagattttttatagtcctcatatatgcgttgttgttcttcgttcatctgcccccgttctattagctggcggatataatctctgttatccagttttccgattttatccattagctttaaagagggcgaaactgctacgttcagccactgccatgttcgttccagtgtctttttctctggattcatggtcaactttatcttccctacatcctgcatgagttcttcccacgggggataagtaggataaagccgttttcttgtaaccgtgctgttttccggcttctgtaaaaaccgcactttctcgtttaatacagacaacgcaatccgtgccacatccctgtctttcagaagttcttctactaatctgaccgcttttttgtgccggaatcgaagttcatatctgttccagtccgggttgagttcttttccgaacttttctgcctgttcatatcccttttcatagaatgtaatccgaaaatcactgtgtttactgccgagatatagtgtttttccctgcgcttctatttcatcctctttcagtctatcagaacgattctctgctgtatcacgcaactgactagatatcagcccctcgtttttcagacgaatcaattccgggatagacagataaggctttgtatcgtcgattgccaagtctatcctcggaaaattcaccgggtatctgcaaactctttccagaaaatcaaaccatgtttccttattcatcataaggaaattttcataattcctgcaccccgaaccactcataagaatctgaaatccctcatactgtgcatttcctgtcggtttcagaatcttgatattgtcaaatcttgctatcagttcgtgtccagcaattcctttttccttaccatgcagttccataaaactcagtggaatccgcaagatatcttctatgattatgaacacgtctacacctttgacagtaatctgacaccagtcaatcagtgctgtcaaatcttctttctgacgagttacccccctgttagtataggggggttctgaaattttcattacctctgttatcatcatccctgcctttcgtagtatgccgtggctttcgccacgttcccggaacttctctactccctttgctcctttcacgctgtacggagcagtccgcagagaatttccgggaacagtctctacacgtttccttttccggtaacaacacggatacccttgcaggagattctgtccaccaataccgggaagtttcctctctgcacataaggggcatataccgcttcttctagttctaccactgtgtaaggctctacctttggaagttctgttgcttccagacggatatctacgctgtttccaagtttcatgcttccgaggtgaagtttcaatgcttccacttcctcggttttcttccgggtttccttatcatacttgtagcagtagtctgctcccatgtaacggagttccccgaacgcttctctgacctgttcttttgtcaatgtaatctgcatgctacatttctccttttttgaaatcatggtgaatgagtgtctgtaagtgtgacaagtccttttcatatccacgtctatatttatttcattacttttctccttacctcttaacctcatcatagacctgttttttcttcttgtcaacaattattttactttttcccttactttttatttttgtatttcaaacgcttaactatatctttttataacttattataattttacccttacatttatccttatcttgtgttatgatgaaaacagaaacgaggtgtgcatatgtttgtgaataaagaagcagtaggaaaacgaattttacagatacgcaagaaatacggttacagtatgcagaagtttggggaaatcatagataatgccccgaaaggctctgtaaacagttgggaaaagggtgtgaatcttcccaatgagaaacgcttgaagcagattgccacgttgggcaatatgacgctgaatgaacttctgtatggttcatttaaagaatatgtagatatgcttatcacagaaaaactggggattgaactgccggaagaatttaccagaactttctattctcttttagagcagaacggatttacctacggggatgatatcgagattgtccggcttgtaaacggctttctgacttatcataaccttacaacaaaagaaaccgccattttctatcagccaactgcatactccggcgattattttgacggtatcatacaaaaagcggattcttccgttctggtctgccgggcatatgcagataaggcaaacaacaccttacatatcattccggcttttgagaatggacagactgaggaagtagcagacttctttcatgcactgaaaagcataaccgctccacacaacaacaattatttcacttccggctttctgacactcggactggcattgagagattccaaagtaattatctatggaattgatgaaaaacagggaacagcacaggtaatcccttacgaatatgattgcgaatcagacgcttatatccagaatgaacatctgtcatataccagacaggatagctttttccgagaagccacgaaagaagcggtctattggaaaatgcaatccgacagaagtaacccataagataaacaagaggacttgcaaggtttgtgacctttcaagtcctcttatgtatcatgatggtattggctgtgtccgttccgtaaaggactgccctacggcgtctcggcttcgccttgttcctttacctcactaataataatgttctgatagcagaactcttacttatacttttatcttactattctttcaatttttaccgtttcaccatcaatattatacttaaaaaaataaaatttaataacatttccttctgatacttgttctagatcacctttacacttagtacaatctaaactaacttttgtcgtatcaaaaaatagactactttcttccttctcatttagttctattaaaagtgtatcaaaagttttctctacaacaaccccactcaaatgaaaccaatgagaattatcatctccactagaacgcaactccatattttgacgattctccttaaaaacatttccttttacgccaagcacaattaatactattgcaagcaaaagtatgattaacaaaatcaatcgtttcttatccattaaatgtagtccccgatatgtctgtccaactatcaaaatcaaaattcaaataacgtactgtatccccccatccatcaaataccatcaatgtatgtactgtatttccagaattatatgctcgcaaagttgcatatccctctgctgccattgaatgccccgcacgttctccagtatcactgctaattataccacaatggacaactgctatatctcctctatcaatgcaattagtgaaaaaattataattgggactatagtcagtattttgtgttacagaaacattctttccagcacaaaagtccacaaatccaggtccaatattgccaatagttgttgaaccatatgttattcctccactctccgatgaaactgtcgttcctgttgaatcccaaatatccatataatcacctgcaatatctgtataatcaacagcattataatatgcaccacatgctaataatgcactaactgcacatgcataatgtcctgttacactttctatatacggctcattaaaggaaataaattcttgaagatgatttgttgaaacaagcgtgtagttttcataaacttcatcaatatctagcaaaacctcatcccaagtagctgggtcttttcccctactctcattcaaggacagtactgttttttctaatgtttcaccataattcgttctaatctttcccaaattatcaacaataccatattcaaacggagctattttatatatttcagaggtatttgctttttcactaaatacatttgcttcactttgataaatcacctcatatggatttgctgaattattaccaaatgagtattctgatatcaaagattcacacgtagtatcaaaaactacatatccatatggtttgttttctaaattgtaatttacaatatatccaatagcttgacctgttgtatcataaaattttctcggattattagcaacaatattgctattttctcctattccctttgcaaaacgttctgccatctgtatcgccaaatcatccgtaacatttacaacagaagtattctccgatgcatggacaggaactattgacataatagtcaatataaagattgtcaaaagtgaagcaaatcgtttaaaaatttttctcataaatatccttcctccttagattatatatttactttaatattatatcttattccctattttgtctatattttttatgtttatttcaaatatttcattctattttatttttatcaaactattttcaaacaaatccaaacaaagaatctcggggcaaatttcggtcaaatcaggataaataaatataacactttatatgtaagtcaattttaaaaaagcctgtaattccgggctttacaacactttgtaacacaatataaaccagttcgataatccctcattcctttagataactataacgacaacaaacgccacaggccgaaaggtttgtggcatttgtcgtttcttttttcagcaaaatttaatgcttgtttaaaagttatatgctataataaattatcaacaaaacccttatatagcttatcattttctctcatttcccaaaaagaatgtttcaaagaaagcggtggttactatgaaaggaaaatatctttttacaagtttcattatgatttcacttatcatgatagtctcagcctcttgcggcagttccaaaactgacaaaacctcacaggaaacaccggtaaactacaccggtgaaaatatcaatcagcttctgacctataccgttccagatggataccatatcgatacagagaattgtacagataaaaacgaagcttcatacacaattattttatcctctgatgacttagatgaagaagtatttactcttgagattatctcttataaaaagcaaggtgtagcaatcactgacgattgcgacattgatatggactacctgttaaatgtttccaaggattctgtgattaaaaagataaccttaaacgacacatttacagtagatgggcatacctgcaatgaagttacagagtactggccatatgatccggatgaagaattcatttcttcatcccagaatcctgtatcatatcttttacatgctctcggattcaaaaaggagcaaaaaacgattgcatttgaacaggcatatattcaaaatggtgattatattatcggagtaggcgtccgaagtttcaatgcagtgcaagatattgaaaatgatgtattaaaaaaagatttgtataaaatactgaattccataaaattttcaggcaacctataacaaatcatcctgaatatcttcctccagcatccgtatccccgcaacactggtcaccggcagcgagaacacaatcgtacgttctttgctgtcaagaccggcctgctccataattgctttcatgatctgattcttctctctgctcttcgttacaatcagtatgacttctttttcttccaccagtgacaccccgagatatttctttgcaagttccatcccggttccttttgcatggatcacagttccgcctccggcctttgctgaccttgccgcatccatgaccgtgtcgatatatccctgatttgcgattgctaccagaagttcataatctgtatctttcatcgaagtctcctcctctttttcaaattcctgttcatttacaagaaactgcagtgtctttcttccgcccacgctgctaagcggcacaatgaacgatacccctgtccctggtacatcgatcagcatcttcgtgatcagtccccggcgcagctttttccacgtctctcctgtaacgattgcaagaaataacaacttttccgattcttccaggccgaaataatccagcacttcactctgtgccgtcccccttccggtcgtttccagaaatacgggaagtccgtactctttaaaaaatgttcggaaatcttttcgtttgtttctgttcgtgatggtcaccatcatatataccttactcataaattctcccttacagctctataatatccgcatccccatatgcctccagcggtaataccttaacaggctgcgcgagcatctcttctttatccttcttacgctcctgatactgatacactacgcccagtatctgtatcgtaataagtggtgtcattgctaccattgctaccactccaaatgcatccgttaccacattcccgccaaccgcttcacatgctccctgtgcaaacggaagtaagaaggttgccgtcatcggtccggatgcaacaccgccggagtcaaatgcaatcgccgtaaatatcttcggcacaaataacgccaagattagtgccagtgcataccccggtaccagaaaccacaggatcgagatacctgtcagcacacgtatcatcgccaatccaagggaaaatgcaacgccaagcgacaggctatattccattgcttttcccggtattgctccggaggtcagctcttctacctgctccatcagcacatatactgccggctctgcctttacgataaagtaaccgatcagcataccgatcgggatgatcacccagcggtaaggaagccctgcgatcacctgtcccagataattacctaccggcataaatcctacatttacccctgtcaggaataataccagtccaatatatgtatacaggataccgaccaaaattttgatcagcattttcttttttaatttcagggataccacctgaaagaatgtgaagaacagaatgattggaagcagtgagccaccgatttccttcatataatgtgggattccggactcgaataatttccacaatgctacagatgtctctgcatccggtattacagtctcggaatagctgccaccttgtggatgatagataataccaagaagcagtaccgccagcaccgggccgatcgaacacaacgataccagaccgaagctgtccgtctctgcgtatttatcactacgtaccgcagagaatccgattcccagtgccatgataaacggtaccgtcatcggtccggtcgtcacgccgcccgaatcaaatgcaatcgccagaaagtccttcgatacaaaaaatgtcaggataaacactaccggataaaagatcaacagcatataggacagcggtttggaaaataacatacgcagtacagcagccaccagaaagattccgactcctacggcaactgccagaatcagcgtcatattcgacactgacggtacctgccctgccagcacctgcagatccggttccgatatcgtaatgatgaagccaagtatgaaacacaatccaataatcacgggaagtcgcttcgactgtgcaatccgagttccgatccgttctcccataggcgtcatcgacatctccgcccccagtgtgaagaacatcattcccaccaccagaaggatcgctccaataataaaagccatcagaatgcccggcggcaccggtgcgatcgtaaagcttaatatcaatacgatcgcgatgatcggtaccaccgcttccaatgactcttttaatttctctgataattttgtccgatataaattcaataaatattcatgcctttctgtgttaattattctacaattttctgactattcaatatattctttatattatcacagaattccaatcctatctatttttctactgttaagatcttgctaagaacgcttactctgtaaccatatccttagcaaataatgctgctcccagtgctccacaaagctgtgccttatcactgattaccaatgttgtaccaagcttctcttccagtgtcttcaccaatccctggttcttggacacgcctccggtcatcatataacgttcctcgccgccgacacgttttgccagtgctgctgtcttggacgcaacagccttattcagtccatgtacgatatcatcggttgccttattctgcgcgatcagtgatacgacttcggattctgcaaatacggtacacatactggagatcgtaatgtcttccttatatgacagacctgcctttcccatatcatccaggctcatttccatcgttcttgccatcatttccaggaatcttcctgttcctgcagcacatttatcattcatgacgaaattggctacagccccgttctcatccaggcggatgaccttgctgtcctgacccccgatatcaataacagtacggacttccgggttcaggaaatgtgcccctcttgcatgacaggtaatctctgtaatactcttatctccatcagaaatggctgttcttccgtatccggttgtaaccattgcatcgatgtcttctctctgaagtcccgcatccttcaatgcttcttccagtgcacgctctgctccgattgctgctcccgcacctgtcggcaggatgatccctgtcacgatattttggtctttatcaagaattactacatctgtacttgttgatccgctgtctattccggcaaaatatccttttcccatcttcagttccttcccttccagttgttccatattcatgctctctgcaaatgcttctaatcttgtcagaagctgcccgctgctctgcaccgtataatccgattcgatcttcagaagcggcacggtcacattctgcttaatctgtgcatattcaaaactgtaaaaatcgcagaatttcacagtatgataaatgattccttttaatccgggatcgttatataatctctttcttccgctgtgatccatcattcgcatacatggaatctgtccgagaagttctttcgcataccatgccatcagctcatcgaattccagatcttttggcggctctgcctcgcccaccgaacggttattgacacaggtatcattttccaccggatatggcatacttttctgtaccatatcaaaaagttcatttcccatacgtgcacccagcacactgatatgcggctttacgatgcgttccggcttcttgaatgcctgccggaacttctcttcatcaaatctggtacctttatattctccatatgctttcgcaagaccttttaactgcactgctgtacgttccctgctgcattctgcatcacagtgaagtacatcaatcatatataagaaatccagtttcccgctgtcttccagaatatcatacacactccgaatcgtgtcacagcagttgaccaacaccagttcctttacttttccactcataacagcttccagaagggccttgccgaatccacagatattcggatgcgctatctgatccgcatggtcaaagccctgcggcatctcattcaggttctgacattccccgccgaacgcttctaagagttcgattggggtatatttacagacataatatgttttattcatcgtgcgattcctcctgtctgtccgtattttcatccgtttctgtattcagcatctctaagaatgccccgagtctggtagatgtctgcccttctccgccatgacttctgtcgcatccatcgccgtccaggatcagaagcgggattccctgttcttcgaatttgcgcttggcaagctgtgctgctccaagggtatgcttacatccccagtgtccgaaccaaacagcaccgtctgctcctgtctcctttgcatgacggattcctgcttcgactcttctgatcgcgcttccatttaatgcatgatataccatacgtctcgccattgcctcataaggcttctccggatcaaaatccggctcacagacgtgactcagttcacagccgacaatctgtgctttttcctgaaagcatagctcgttcttcaccgcatcagaccagaatgggatcgtatgcatccagtagattttctttcctttttttgcaggagcattctttacatctttcaaaaggcggtccacataatcctcttcttcttttgtgccaagcaaaagattgttggtcattcccacataaagaggcgtaaccagatctgccggaacatatttatctgcactttctttctcatactgtgcaaacttctccagtgtccgtttgcttcttctaagccgttctgttaatgcctcatctgtaatctttttacccgtacattcttctataaactctttcagcttccgaagctggtctgacacatactgtacattgtcctcattctgctgcatcgggacatcaattgcaaagattggcacttcatacattttcgccaactttttaaacgtcagaaggtttgcatcacaggtcaggttcgtgtacacaatgcactttggtttcggaagcactttcttctgtgccgccccgataaatgtcttatgataactgcaaagtgtctcagaaattcctgtattttctgcctgctgtaaaaatgctctttctgcctttgatgcagaaagataacaggaaaatccttccacattatacggatggattcctgcctcctgcaacagttcgcaaggagtaaagatgctgactattgcactttcctgtggtttttccaaaggcataagcatcgtatccatcataagtcttgccagataccggtctgccggcatcagtcttttgtccggggcaaaccggaacttcagattctgtgccttccatccggtctttaaaagccatctggctctgtccggatcctcattactccatttttctatataatttccatatgtttctatgatcttcatgttctcatcctcgtcttaccctgttgtctgtttccatttttcttccttattcaaatataaaaaacatttaacatcatactcttcttttttataaaatgcaaatatacagcagcaattttccgcaaatctgctgctgtatatagatatcaacgtatactaccttgtatttttttgttttcttttttcctgtacaagcactaacacgaatccggctattccaatcagtgacaatacttttcctgttgttgttcccggtgcatgatagatgatcttcacttcatggttaccactttcgatcttacaccccagaaatgccgtatttactttttgtatctctgtttcttttccgtcaatataaatcttaaaatgtttatcataagagatggacgtaataaaccatccatctttctttacatgaattgtcccctggatcacgttatcttctgtctgctttttgtccacctggatttctgactgatacaacaattctgaccgttccggcagactgccgagatatgcctgtacatgccttaatcgatatttccctttgccaaatgtcacagaaatattatcttctccatcctttaacggcactgcataggtaaatatcttattttcattataatatacatgatctttcgcgcttagtttgttacggattccgttgatccagactgccacgtccttattcggatgtgcgttgtccacccggaatcttaaaaaaagaatctgtttcttcccctcttgctgcatcgttttctgctccgctccacctgtagttctattattgtccattttcagactaaccggcgcataggctgtcattatgttctgatctgaagattccgtatgttctccaacaaccgcatattccagaaatgccgtctgattatatggaaatgcaagtttcttatattcctcttccgtcatcacacgatctgttgcatacatgaccggtgctgcgtctttattctgatatataccggttgtgccgcatttcttaaccagagtatatcctggcacatccgaatctgatacgatataccgcactcccatcatccgttgaaataccggatttttcgagacagactgcatcatcccattgcggaacggttcttccagtccgaatgtcttctgacggaatgtctgatagtccggattgtatgccgatgaatagatggaagtaatattctgatccacatcccagatccggtttaaatctgctgcattttcatcatcacttcccatctgttctgtacggtaatatccagcatcatcttttaatgcttcttttatggcctgtctgttctgttctcctgtaacatcccggtacagtttgcggctgacatatctgtccggcttcatctgataaaaagtgttcatcgtgactgccagacatatcaccgacggcagagccagcatcagaatctctttcttctctttgtggtatctcttcatcgcacaatacagcacgtaacagatcagaaacagaatactttctgcaagcaggactttccatatactttcccctatgccttttgaaacaaactgattccttgctatataaacgaatatcgttgtgatgatatatggaacgattcctgcaataaaagacagttctctttttctgcacttttccagataaatggaaatcagataacaaagcaatggcagaaacggaataaagactttatccctgatatataatccgccattcaataagtaagcaaataccggaatcacaagtacgatcacacatccatatgtgagtaccttttcatatactttccgatacaacaatcccgtgagcagaactgtgatcaccagtgtcgtaagtccgattccatagatactataagcaaatcgttctactgtgatctgcggaataaaaaaggaagcaaacgatatgttctgctctttacttctcccacccgtcaatgcgagtgccgtcggtaccagaaagaaaccactcatgagtactgccagaatcatcgaacgcacgaaacacaatccgtcccgcaaaaagctgcgaactgtgaccctgtttccttctctttgttcaaaatagcggtgcagtccataaagaaccaatgacagcattccgccaatactgaaataaaaactggtcatgatcatcagaaatacactaactgtaaaaagaccacttttttcttgctcaaaataccggtctacacctatgagtgccagacataagaacggcatataatccacaaacatgatctgcccgctgtactgaccgatcatcggtcctgccagcaggaacatcagtgacaggataaaagcagtgcctgtatccgtctttctgcttttcagccagtaataaaacagcagtaccgaagcagtcagacctgttatgctgaccgccatgatgtaatccgacattttcacaaacggaagcagatatgacggcaggatcaacggactatatagtccgtaataagcaaaatgataaatattctggccgccgcccagattcgccgcaaattcgggaaataactttccggttgcataaaactgctgccggaaataatccggcagcacactatgctgactgagccagtctacctttgctccaaagattccatatctgcccacaaacatccagcaaaaaaagagtgttaagcctgtaagcagcaggtaaggaatgtatctcttaaccttgtccataactcttcctccgcagattttgtgataatggcatcatcatgatccgctgttcttctttactggaatcctttaacaggtatacaggccggttctttacttccaggtatgtcttggcaagatactgtcccagaattccggtacacagaagctgtacaccacccacgccaaacaagatacaaaccatcgatggccatccggccaccggatctccccagattaatgtacggactacgatcgcaacaatcatcaggaatgataatccgcagaacaaaactcccatatacgctgcaatcgacagcggaactacagaaaatcccgtgattccctccaacgagtaaatgaataatttctttacattccattttgtttttccggcagatctttcgatattctcatattccagccatttggtgcggaatcctacccacccgaagattcctttggaaaagcggttatattcactcatttccagcactgcatctatcatcttacggttcatcaggcggtaatctctggcaccgcttacaatctctgtcttggaaatcttattgatcacgttgtaaaactctttagataagaatgaacggatctttggttcacccattcttgttgaacgtctggttgccacgctgtcatatgcttcttcttttaaaattctgtacatatcaggcagcagcgacggcggatcctgcagatctacatccatgattgctgcataatcaccgcttgcgttttgaagtcccgcatagatcgctgcttcttttccaaagtttctggaaaaggataggtactgacatcttccgtcctttctgtgtaagtctttcataatctcatatgttctatcggatgacccgtcatctacaaatagcagttcaaaactggtctgttttttcatgctgtccatgacttttttcatttctgcataataaattggcaatgcttcttcttcattgaagcacgggatgataatactgatcttgtccataacaataagcctcctcatctttttcttgatgctattgtaggcttcgtttcttaaagacatgcgcaaataattcttaagatttcttaaaaacttctgttattttttaaaatataagttctatcttcgtaccttcccccagtttactgtccacatggatcttcgccccatgaagcattgctccatgctttacgatagacagtccaagacctgttccacctgtttctttagaatggcttttgtctacacgataaaaacgttcaaagatacggtccgtctcattctccgggattccgattccggtatccgtaacgcagaccttctttccctgcagggtattgcctacccagacggttaattttccgccttctttgttatacttgatcgcattttcacagatattgtaaatcatctcatccaggatctgacggatacccacatactctaccggttctcccgtcacctctacatgcactttccgcttcgctgcctgtggtgaaagtctggtcagaatctccctcgtcagcttatagagatctacttcttctttttccagctgcacattgccctcatccagttttgataacttgatgatatcttctaccaaagtgatcagacgccttgcttcattatagattctttccgcaaaacctttcatatcttccggctttaccagtccgcttttcatgatttctgcgtaacctgaaattgacgtaagcggtgtcttcagctcgtgagatacatttgccgagaattcttttctcatattggcaactgcatctttttctttattctgcttgtcgatactctgtaaaagaggtgttaattcttcgtacacgtcattctccaatggattctcaagatccagtctgttgatcgggcggatcagtctcgttacctgccattttacaaggatccccgcaaatgccagcatgatcaatgcgatcagccccatcgccgggaataccttcattgctgtccggaatgcagtatctaccgtctttgatactcgcaggatatctccattttccaatttcactgcataatagaacatctctttattcaatgtattcgattcacggatatcctgaccacttccgtttttcagcgcagcttttacttccggccggttcttgtgattctgaagggttacatcatcttcttttgagtcatatttcaccttaccatccggatcgatcagggtaattcttgtgtccacatgcacgttatccatcgtcttcagataagactccccggaagtgtcgagtgctacgttaatatagtccgcttcctgtcttacctctccttccatgatatggatcgtctggcggtatacaaccagcgtggtgatcgcataagctatgagcatcgtcagggtaatgacaagaatcatgctgctttggatcttttttctcatactttgtttcatattattacctgctcatacggtatccgactccgcggaccgtctcaatctgttcgcctgcatctccaagcttctgtcttaaagttctgacatgcacatccacggttctcgtctccccatcgaaatcatatccccagatatcttccaaaagctggtctctggtaaggacaatattcgaattcttcatcaggcgtttcaataattcatactcttttagtgtcaggttcaccacttctccgtgaacggtcacttcatgcttcttcggattcagccggatctctccaatctcaaatgtatcctcactggatatgtttccatttgcgctgcgtcttaataccgccttgatacgtgagatcaactccatcatgccaaatggttttgtaacataatcatccgcaccggcatccaatccttttaccttatcgtattctgctcccttggctgtaaccatgatgaccggaatctctctcgttttcttagatgcttttaactttctcaaaagctccattccgtcttctcccggcagcataatatcaagcaaaacaagctctggcgtctctaatgccagagcttcaaggaatgaacttccatcttcgaatccgtgcgcctgaaaccctgtgctctccagggtatacaccaccagttcccgtatgttactgtcatcttctacacaaaaaatcattcctttttctccttctttatactacagaagccttgtggattcctgtgatagagaattccacccactctgcgatatttgttgcatggtctgcgatacgttctagatattttgcaaccatgatcagatcaatcgcctctcccccctgctctcctttattttccgcaataaaatcaatcagtgttgtcttcacttcttcaaaaagttcatccacaacatcatcatcttttataacttttctggaaagttcaaggtctttttccacatatgcattgacgctgtcacgcaccatctttccggccgcttctgacattttgatgatctttggaatgtcctgtgcttccgacttctcctctgtaatgatgatctctgcaatatccgaagcctgatcgccgatacgttccatatctgtgatcattttcaatgccgctgaaatctgtcttaaatctcttgccacaggctgctgctggagaagcagtttcaaacaaagtctttcaatatctgtctctgcctgatcgatctcttcatctgcctcgatcaccttctgtgcctgttccatacttccttcttttaatgctgttgttgcttttccgattgcaacttcacataattcacccatacgtgtaagctgctcattaagtaactccagctgctgatcaaaccgattacgcatatcctagccaaacctccctgtgatataatcttccgttctcttatctgccggaatcgaaaataatttttctgtttcattatattcaatgacttctcccaacaggaagaatgccgtattatcagacacacgtaccgcctgctgcatattatgtgttaccataacgatagtataatcttttttcaattccatcgcaaggtcttctatcttagatgtcgagataggatccagtgccgatgtcggttcatccataaggagcacttccggctgcaccgccagtgctcttgcaatacaaagtctctgctgctggccgcctgacattccaagtgcgctggtctttaatctgtccttgcattcattccagattgccgcatctcttaaagatttttctaccaggtcatccaattttgcttttgaacgtattccatgggttcttggtccataagcaatattatcatagatactcattggaaacggattcggtttctggaacaccattccaactctctttcttaataaattcacatcgatatcatggaaaatatccttgccatccagaagaatctctccgtcaatcttacatccctctaccagatcattcatacggttgattgattttaataatgtagactttccacatccggatggaccgatgaatgctgtgatcttattcgcttctatctcaagattcacatttttcagagcatggaaatcaccgtaatgaagttccatgttcttgatacttattttactcatgtatgattccttcctgtttttttctgatttatctctgtacagctgctatgcttttgtaatccgtttggcgatcatgcccgacagggtattgatcacaactaccagcaccagcagtactacagccgtcgcataagcctgattcatataaaggccttcacttgacagattatacatgtgcactgccagggttcttcctgaactcaatacattcttcggcacctttgcaacagtacctgctgtatagatcagtgctgctgtctctccgacgattcgtccgatcgccaggatcacacctgcaaggattcccggtatcgccgatggaagtacgatccgaaatactgtacgtaattttcctgctcccagcccgaaacttccttctctgtaagaatccggtacggatttcaatgcttcttctgtacttctcatgatcagcggtaataccatgatcgcaagagtaaacgctcctgccagaatcgaaaatccccatttacaggtatttacaaagaacagcataccgaacagtccatatacgatagatggaattccctgaagcgtctctgttgtaagtctgatcacttctacaaatttattcccacgttttgcatattccacaaggaagatcgctgcaaagatcccaaatggaactgcgatcagaagtgataacagggtcatgatcactgtgttgatcaatgccggcatcagcgaggcattttccgatgtataatgaagtgagaaaatggatggtttcaaatacggaacaccatgcgccagcacatatacgatcagaaatataagtactgcaaatgtcataattgcagaaatcatgacaagaagcattacgatcagtgatccaggagttctggtatatgcttttaacttatctttccatgttacttcattactactcataattcttccccctcttcaaaagtgctacacagaagttcagaagaaggataaatacgaagagaactacgccggttgcaatcagtgcttctctgtgaagtccggatgcatatcccatctcaattacgatatttgctgtcagtgttctgactcctctgaagattccttccggcattctcggctgattaccagccaccatgatcactgccatcgtctctccgatcgcacgcccgattccaagaacaatagctgccactactccggattttgctgccggtaaaacaacagtaaagattgctctttcatgtgttccgccaagtgctaccgcaccttcatagtactgtgtaggaactgctctaagcgcagattccgtaagtccgatgatcgttggtaagatcatcattcccagaagaatggatgctgtgatcatactgcttccgttccccccctgatgaagtgttcttccgatttctcttacccacggtacgagaactacaagaccgaaaaatccatagacaacggatgggattcctgccagaagttctgttgccatcttcagtggtttatagattactttcggacagtagaatgccatgaatactgctgtcaggattccaatcggtacaccgatgataattgcgccggccgttacatacagacttccaatgatcatcggaaagattccgtatatgtcattctttggtttccataattcaccggtcaggaattccccgaatccgattttactcattgcaggaattccatttgcaaacaagaaaatacaaatgagtgcaaccgccagtaccgaagcacaggcggcaactgcaaacactccctgcatgaatttctctgtccatgcttttgatttcatattatttcactacctcatcccatgtggttgcatcaccagtgtaaattgtctttacctgatcactgctgagttcatctgttgtattgtttttatttacaataactgcgataccgtctgtagcaattacctggctgtccagtttatctttttcttcatcctgtaattcacgtgatgccattccgatatcataacttccgtcgattgctgatgtcatacctgttgtagagtctgtagtctgaagctcaatctctgctcctgtattaactttcttatatgcctcgatcaatttttccataaccggtgatacggaagaggatccgccgacaactgcttttccggatggcttgcttcccgcataagcttctgctgaatcgtctccgatatatccgttgtctgaaattacctgctgtccttctttactcatgatataagcaatgaagtcttttaccacttcgttatctgcacctttctttgttgcaatgttaaatggtctgcagattttatattttccatctttgatgttctgctctgtagcttcttctccgtcaatctttaaagcttttactgtatcatttaatgatccgagtgatacataaccgattgcataatcatctccggctactgttgtaagcattacggatgtgctgtttgtaatctgtgcatcatctgttgtcatatcaactttttcaccgtctttcttttcttcaatcccgaaaagttcgatgaatgctcctcttgttcctgaaccatcttctcttgaaacaattgtgatatcattcgaagaatcccagtcacctttactgctcttatcatcagaagaaccactatctgcacttccacatccaactgcaagtcctgctgccattgttgctacggataaaactgcgataaactttttcattttcataatcatactctccttagattctcatctttttttattctgatttttttctttgtcgctttcgacaatagctatcttataaaacatatgttaaatccaaaatctgcgaattgttaaatgtgtgtaaagtgtatgtaggaaatgtaaaattgaatttcttaatttttcatgctataattcctctgcaggacttttcctgatcagctttttcaaaaattatattcgatattaacctttatacaaaaagctgacagtaatatgttctacagattcgaacacaatgaatacaaacatatgaaaacttattatttgagaagaaagaggatataattctatgtggattgcagatcaatggaaagattatgaagtaatagattgtagtaaaggtgagaaattagagcgctggggacagtacacgctggtccgtccggacccgcaggttatctgggataccccgaaaaccgagcgtggatggaaacatatgaacggccactatcaccgcagcaagaaaggcggaggggaatgggaattcttcagtctcccggaacagtggcagattcattataaagaactgacatttaatctgaagcctttcagcttcaagcacaccggacttttcccggaacaggcaacgaactgggactggttctctgagaagatcagaaatgcaggaagaccgatcaaagtactgaatctctttgcttacacaggtggagctactctcgcatccgctgctgccggagcaagtgttacacatgtagatgcttctaaaggaatggttgcatgggcaaaggaaaatgcagcctcttccggattatctgacagaccgattcgctggctggtcgatgactgtgtaaaattcgtagagcgtgagatccgccgcggcaatcactatgatgccatcattatggatcctccgtcatacggacgcggacctaaaggagaaatttggaagatcgaagatgcaattcatccgctgatcaaactgtgtacacagattttgtcggatgacccgttattcttcttggtcaattcttacacaaccggacttgcgccggctgttttgacctatatgctcggaacggagcttaagaaatggaacggacatgtggattcacaggagattggacttcctgttacacattccggactggtgctgccttgtggagcttccgggagatgggaagcggtttaatgcaataggaactgaatttcctggtcccgaataaaatatagaagcgctttctgtgcctaaaagtttctaaccatgatctcatatacacagaaagcgcttctatatttttattcagttacgttttcgcatactctactcattaaacaacttctcatgaatgttttctatattctttataccatttttctgcttcttcagtggtcatatgcattccttcagccagttgttgaattgtttcatttttacccagattaacaagttctgccaaatgtataattgctctaataccttcgattcttccttcttcacggccacgttctatccccggcttctgtaaaatcaatcatcagttcgcctaacgcaacaatatcaacctctttttccattcttcagatcctccacaatttcattataccgttttttatttaaccggtagaaaaataatacaacagctgttacaatccacagaatccccggaatggttgtaaatgcatatttcataatactgataaccgtatcattttgtgcctgatttgccacgtatccatattttccaagtaatgccgcaagcatcgctgtaccgatcgccattccaatcttatttccaagagaaacgaatgcatattgaaatccatcattccgaagtccggttttccattctccgtattccacacagtccggaatgattgcatagattgctgtattaaatcctgaaaaaaagaactgtgtaacacctgccaaaatatagaatacaactgctgaatcttttacattaaagaaatacattgccagcattgaaatacctgttaaaaaggcaaatatcgaagctgtccttcctttattgttaagttttcggaataccggttgaaaacatgcggcaccgataatggatggaataataatgcacatagaataagtagtataataagatgcatttccttctacatatgtaaaataatataaaatgtcagcatttcttccatataatgtaaatccaaataaaacctgtccgattaatgcaagtatatacggtctgttctgcatcacggcttttaactgtactttaattgatattttttccttttccggaattgtcacctgctccttcgtcttcgcaaagcagaagaaatggcatgccgcaaatatacatccatagataattgctacaaataaatatccgttcttcgcactctggcttcccagctttccaagcaaaggtactgtaataatgttgataatcccgattgcaatcatagccgcaaccgaacgcgaagtattaatttttgcccgttcatcaatgtcctgtgtcatcgcaccgcaaagtgttccatacggaatatttacacatgtgtatcccagtacaagcaggcaatatgtaataatcatatagataatctttgccgtatctggccagtccggatgtgcccagaatgtcaacattaaaagcactgccgtaatgggtgctgcaacaagcagccatggacggtaacgtccccatcttgtttttgtcttatccgtcaaccctccgacaatcggatcattaatcgcatcccagaatcttgaaaataacatcaatgctgaaacagccgccatactgattccaaacacatctgtataaaatatcattaaaaaattacttacaaacatccaactgaaattgcatccgacatcaccaaatccatatgcaattttactgatcaatgacacttttccattcttaccctcgtttcccatggctcctccttatcagcgtttctgacaaaacttctgttctctcctgatctaatctttattcctgtacattaatgattactttcatcgttgtttcccggttatcatcgatatattgataagctttcagatactcctggaatgcaaatgtttttgagatcagtggtcttaaatgaaccttttcttcatttacaagtctgattccgtcaacatagtcatcgtgccggtacatcattgtgctcttgatatccagttcgtgatcattagccactgcaagatcaatctctgccattcctgcaaacactgcaaccaatacaataatgcttccttttcttgcatacttgattgcctgtcccattgtgatgttatttcctgcacaatcataaatcacatcggctttgtctggtccgaatgtttccaacattgcttcaccgaaatctttttcttttgtattcacacagacatcaatgccacattctttcgccttatccagacggagatcactgacatccgtgatcataacttttgctgctcccattccctttgctacctgtgccacaagattaccaatcggaccggcaccaagcacggcaatgttcattcctttcacatcaccaacctgctttactccgtgaactgcaacagccagtggctcgatcattgcaccttcttcatatgacatttcttccggaattggtgttactttcgatgcatctactgcaaaatattctgatgctgttccggttgtctggaatcccataacttttaattcttcacacaaattgtattttccgtgtctgcatggataacattctccgcaataaacctgtggctcaattgttactttctgaccttcgtgaaatactgtcacatctttcccaagttttacaacttcaccggatacttcatgtccctgtgttaccggatatgaggtaaatggatgcttaccgtgatatacatgaatatcagaaccacaaatgccgatattcataatctttaccaatacctgatcatcttttacctccggaactggtacctctctgaaaataatctctcctggttttgtcattacctgctgtaacatattgtttttctccttcattcttttatcttatcttttattaaatgttttattaaagtaattacattattgtacaaccactctattttgtcaatatatgaatgcctatttctacttgttgcacaagtttgatcaacttttttatgcatatttaccaactggatatacatagaatttgccactggcaacttctcttgcatacttagatatctataaaacctgccaattgcagcttcttccgaacatctgacaataaaaaaaagaggtaaatattcaaagtccgtaatcattacgagccttgaatttcacctcagtttttcattcttattctttttcctacaacatatcaaatttataaatgctgtatatattcagagaggaaatgttttgccgctccgacagctgatgcctctcttttataggagcaattttttaagtaacgtacatcatgttcaaaaccattatatgccatcactttttcccccagtggtatcatatactctgataaataccccccgacttctcctccaagtatgatatctgtgtcatacgccattcgcagattggaaatcaaaatagccagattatccagatactgattccatttttccacagtctttgtatttttctgctccactttttccataaattgttccaacgtcatttcctgctcttcatcagtcaatgcaccggctgcgcaataggcatctgcacacccggcttttccgcaataacatttctttcctcccggcaccagaatcatatgtccgaattctcctgctttctgattctgaccagccaccagttttccattaatacagaatgcgccgcctaatgtattgttgagcgaaagatacacagcatcctgatattcatgcatatcttctgccatcatcgcagcatttgcatcatttgcaaaatacaccggataagaaaatacctgttccagaaagctcagactgaaattctccaattgcagtgcatgagatttcacaaccattctattcgcctgatcaataataccgggaatcgaaattccgattcctaatatcttttcccggtcttctacatccttcaggaagtcctccaccatttcagctacttttaagcaataagatgtttctgttgaaaattttaaccgcatccagattgttttttctatttcatactgcatgttcagcaatacgattcccagatgatttgctgtgatcactacaccgactgcatatttatatgccggattaatccctatccgttttgctttacgaccgccggtagattcatattctcctatctcgatgaccatattccggtcgatcagttcgtttacattagaaagcaccgtcggcatacttaagctcagattctgcgccagttctgcctttgatataattttattattgatgatatagtttacaattttagattttgtaatattctttttttcatttcgccctgccatatcagacctcttttataaattattttacaaaagtatcttagtccttttttgctattctgtaaagaataaatatgttgcttctaaaaaactttttcccaaggcacaacgatataaaacaagccaccgggacagataccactcttttttctccatcccaatggctcaatttaatattcctattacatccgctaacgaatcacagacccgatacgtaagttcccgtatctcctgtgtcggctgcacaagatccggcaccatgatcacatgcatcccggcctgatgtgcggacaggattcctcccggcgcatcttcaaacgccatacaatattccggctgtattcccagactttcacatgctttctgataaatctccggatccggcttcgctttcttaaccatatctccacagaccacactgtcaaaatacgaatctattccggcccggatcagattccccatggcatactctctgctggaagatgtcgctactgccatcttatatccttgcgcttttccataagccagcagttcttttgtaccttttttcagcggaagaccttctttatccacaattttccagaagttatcccgtgtcagttttccaaattcttcaaatggaaagtcttcccggatatattttctgaaatattcattcctgcctgtgcggttcatcccaagtgtgtgatagatgacttcccccatatgtgggattcccaactcatctcctgccatctcccaggagcgctgtacaattctttcagaatcaaataacagaccatccatatcaaatataaatgcttttatatccattttagaactcaatgcctcttccaagtgcatccttcagataatctgcaacttcttctaatttatgtacggcctccatcttctcttcaaactcgtccccgacagattctttattaataagtgcctgttggattttctttacatctttgatcaaattctctgtcatatcaaaagccccctttttattatcttgcaggaaatttactttccgacaatcgatttatcctaatgtatatattatgattatagcataatttttttactattctctgaaattatattacattttaattaatttttgcatattatcatttttttcagatttgttcatgcatcattctgataaattcctccatcacacgtgttttgtacttgtgtgttttgtagtaaaagaagacttttctcttcgcttcttctccgtctaatttgtaatacaccaggttttcaaatgccgggagctggcttaccaggatatcactgatgaatgttgctccaagctgcgtagacgaggccatatatgctgtcgactgctgattgaattccagcacgatattgggcttaaatccgacgtttcggcacagcctgtctcctctggttctggtatcatttccctgtgtcagcataataaacggaagatccgcaaatctccctaacggaactgccggatatttctggctcaggtaatttttattcttgatattcttataagaaagctgatacattcccagttcttcatttacagcaaaatgttttggaaccgcaagtaatatattttcttcgcaatataattctttattatatagaatactgtcatagtgataattatcaatgacaaaatccagcgcattactgcccagcatttcttccagttcggctgtattcccctctatcagctgaatatgtacatccggaaatttctgattaaattgggtgatcagagacggtaccacatatgcggcaaacagcgtacttgctcctactgcaagattccccgtcttcagacccgccaggtcattgatgtaattctctacccgctgttcgatctgggtgatctcctccgctgcctcaatatatacttttccgacctctgtaagctggagcggtgtcgtacttctgtcaaataacggttccccgataatctcttcaatctttttgatccttgcactcaaagacggctgactgatgtacagattctgtgccgctttggtaaaacttctttctttatacacttcataaacatattttttccatacaaacatacacgtaacctctcatatcctgctatcatctgtttcctcttttcacatgacagctatagtcagactcttataattgttatagcactataagtattggattctctgtccacacggacgtatcattatattaatgaaacaattattccaatatgaatttggggtttattggaataaaaataaaataataaaaagcggggaataaaattatgaaaccaatcgtacgcgccgggcgcatgaaaccagtacactctgatatccgtggtccattatttgtagaagccatgaatcgccagaaacaggggatcgatatcttaaaattaaataccgggaatcctgcaacctttggctttggtctgcctgacagcatcaaaaacgctctgatggaacacatgcaagacggtgtcggctactgtgacttcaaaggaatgcctcaggcaagacaggcaatctgtgattatgagaccagtaaagggatcaaaggtatcacgccggatgacgtatttatcggtaacggtgtcagcgaagttgtatcgttcgctttaacacctttgttaaatgatggagatgaagtcttagttccttctcctagttactccctctggggcaattccgtatatctcgaagacggtaaaccggtcttctatacctgtgatgaacaggccaactggtatccggacattcaggatatccgttccaagatcacagataagacaaaagcaatcgttatcatcaatccgaataacccgaccggtgtactctatccaaaggaactccttcttgagatcatccagattgcaagagaatccggacttctgatctttgcagatgaaatctatgaccgtctcgttatggatggcaaacagcacatctctcttgcttcactgacagaggatgttccggtcattacattaaacggtctgtccaaatcacactgtctgtgcggataccgctgcggatggatggtcatccgcggtccaagagaactgaccgaagattacagacagggcatcatccagttaacatctctgcgtctgtgcgccaataccatggcacagatcgtcatccctgcagctcttgatgatatggagacacctgcttctatggtccggccgggcggcagaatctatgagcagcgtgaagcaaccgttcgtgaacttgagaagatcgacggtctgtcatttgtaaaaaatgacgctgcattctatgtcttcccgaaactggacgtgaagaaattcaacatcaccaatgacaagcaatttgcccatgatctgctagatgtcaccaatatcctgctcgttccgggcagtggattcgactggaaagatccggatcacttccgtatcgtcatgcttccgcaggcagatatcttaagtgatgcgattcgccggatgggaacattccttgacggatataagcagaaataatatgagcagcagccatccttaaatagtacatagataaaatacattcccgataaaaatccaatctctcttttttcgtcgatgtttcagttatccgggaatgtatttttatctgcttttcactgtattccaggctccgactacttcatttacggtactgactgtcacaaatgcatgttcatctgtttcgtggatgaaagataataattttccatattcattcttttctaatatcgttacaacttctacatgctctgcatgatccaggcctccatatgccggataaatcgtcgcacctctgcgtaattccttcacaatataattctgaattttttcatgctcctttgaaagaatggatactttcttacgcacatggaatccatcacagaaccggtctaatacctgaccgtagatcaacgtaccaacaagacttattaccattgtctcccgatcatatacaaagattgctgccatcgatatgagcacacctatgatcgtaatactctgtcctattttaaatccaagatacttattgatcaacttcgcaacaatatcaattcccccgctggatgcattcatgttaaataagacggcctgtcctgcaccaaccacgatcatgaagcataccagatcgatcacgatattcccggacaaggattccacatgcggagtcagtatctcaaaaatcctcagatacatcggaagcataagtgatgcaagaacggtcttcacaccgaattccctgccgataaaaatataccctatgaccaacagtatcatatttaagacaaatgtaattgtcgataccggtaacggaatgatctttaccagaacaagaaccagtcctgacagacttccaagcaccagattatttggcatcatttcataatatacagctgccgacattaagaacatgccgcccagcatcataataaattctttttttgttatcttcatttcattcttccttaattcaatatttctgcacaaagatgtactcctctttttttgtgcaaagaggagtacatctttttctgaagggtgtctatgcctaaatctgtttcaggcatatctatacaattatcattgtttttatccagcacccggcggttagtccaccaatgccgataatgtcttgtccagagctatcatgatcagcgccgctgcaaacgatacaaccgcaactccgatacatgctactttgaattcaatctttccgccaaacagcagtccatataccggaccataactctttgctgcaataaatgttgcaaatccccatactgacatcataacagccagataacggctcggtgaatatttactgataaatgaatgccccagtggtgagaagaacatctctcccattgtcagaaggaaggcaaatacgatcagccatagcacacttgccttttccccaccacgcatgatatcaattgctgcgtagaagagatatccgacaccgatgatcgcaattccaagtccggtctttctgaacagactcatatccccttgcggtcttgccgccagtttcttccataatgccgctgttacaggtcccaggataacacagaacagtgagttggctgcatcaaaccatgtagacggtacctgataacctgctactacccagtccatattctctgcccagtagaaatataccggcatatatcccagataccagaatatccagaatacgatggagaataacgaagctacaaagattgcaccgatacgtttcttctcgatcgttgtaagcggctgctttgttcctgtctcttcttttttctttgcctctgctgctttttcctcttctgtcagagtcttcttgaatggaagctttccaagatcacctaagaatctccagcacacaaagatataccaaagtcctccgagaaccatcatcaatgctgccatcttaaagcatggtgcaaatccaagcacaccatcttttgcaaatacatccttatacaggattcccaccaggaatgttccgatgaatgcacccacatttaccagtgtataacgcatcgaaaatgccggatccatctgtgatttgtccgtgataacacgtccgatgatcgcaccgtttttaaataatgcaagtcccagacttaccaggaagatcatcgcatatactccggcagaactctttgcgattcctccggtgaaatatcctgccgcagcaataaacataccaaccggtgtcgtatatctcgcaccgatatacttatctacgatcactgccccaaacagtggaagcagataagaaaatgcggtcaggtttgactgcatattggcagccactgtatccgaaagtccgagtcctccggttgcaaccgaagcagttacaaaaatcaaaatcagcgaacgtcccagataatatgccagacgttcaaaaatctctgtacaggcacatacccagaacgctgccggaaagcctttcttttttgtctccatattcttttccccacttttttctaaattcaatccttactttttatgtacttttattttctcttccttgtttcgtacatatatccttctctgtcttattttatatctttcaagaatgctttatatcctctgtaagcttcataaatatcagccttacttgtcacctcatacggtgcatgcatagaaagtacagcaacaccgctgtcaatgacattcatgccataatttgccatgatatatgcaatggttccgccgcccccaagatcgactcttcccatctccgctgtctggaatccgacttcgttattgtctaatacctgacgcacttttgcgatatattccgcattggcatcgttactgttattttttccgcggcttccggtaaatttattaaataccagacctcttccaaagtatgctgtattctttttttcaaatgcatctgcatacaatggatcaaatgctgcacttacatcagaagaaagcatataagaatttctcagagctcttctgacttttaacggattgccatcttcggtaagtgccatcagttctgccacataatcttcaaagaatctggaatgcatacctgttgccccaacgcttccgatctcttctttatctaccagaatacaacagcttgttctttccggattctctgtttccagcattgcaaataatgaagtaaaagcacagaccctgtcatcctgtccatatccgattaccatacttctgtccagtccgcagtctcttgcctttcctgccggcacgatctccagttctgctgagagaaaatcttcctcttccatatcaagattctcctttaagaactgtactacggctgcctttaccagctctttttcttctttttctaactcatcattgcctgtaagcggctttgttgcaacgaggatatccaatccttccccttcgactaccacgcccgcctttttctcaatctgctgctgtgacagatggatcagaagatctgaaatcacaagtaccggatcatcttccttttccccaataataatgtcctgcactgttccgtctttttttgcaatcgttccatggattgcaagcggaattgtaacccactgatatttcttgatcccaccatagtaatgcgtatccagatatgccatatcactgtcttcatataatggattctgctttacatctattcttggtgaatcaatgtgtgctccaagaatattcataccttcttctaacggtttcttaccgagctggaacattacaaacgctttccccatgcagtctgcatacaccttatccccggcttttaaagtggttccctcagaaatacaatcttccagattcttatatccccatgcatctgccatcttctttccaagctttacacattcacgctctgtctttccgatatctagacattctttatagcggacactcagctcttctaattctttctgctgaatttctgtgtattctttccacatattttttcgctgcattttttcgctcctcctttttccttcgcagtctttctataaaaatagtatctctgtttgcaaaatatatccaacaaaaaaaaagcatgcactataagaaaatcttatgtttttacattattctgctaaatgtaaaataagtgttttctcctttaaaattgccaaaaaattatcgatcgtttttcacaatcgataattttttcttatgagttcactacattcttaatttcttccagaatctcttttactttctttttgtttcttttttttctgtagaatgctttgatcacgcactctccttcatatcccggaagcagcagcatatctccatcactataggagaaatactgactgtctgccagtgcatatccgtcgttaaattctacctttaatttcatggtatccacattgtcaaccaattctattccttgtgtaagcaactgcggatcattcttttgtccattcatcacactgcataaatatgactttgttccatatctggtataacgctcaagatcctttgctttaaactccggctgctcatttatcgatgattccagtccgatatatgctccgatccggctggatatcagcggcttttctcctatttcatccggctgctccaactcatttagtccgtatccaatataaatatccaatgtattttctctcagcatccggctgcctatgtaggaatccagtttactgaagcggaagtctgcttcggaatgcttatcattaatcatcttctgcatctttgcccagaacaatttgtttatagaactatcgattccgatacggactacgctgctttctttatatctttctatctcatgcagcatccgttcgtgcgtctgcaccatctccctggcatactcatagacaatctcccctaattctgtcaggcatatctcaccattgcctctctccagcagagtccctcccgccattttttccaaagaggcgatctgctgacttactgccgtctgtgttacataatttcttgctccggcctttgtaaaactcttgagttccactacatccaaaaaatatttatatttccaaagactcattttgcatacttccttccgatgactgcttcagatgatatatttttcttttatatcttttgtcgacaatcgtcaatgaggttgaatgtaatatatcatatttttgtatatttttcaacatattatttgtattttatatctctttttgtattttatgcacaacatctgtcatttcaaaacctgctgcatgttaaaaagatcgttacaggcatctccttacaacacatgacaaaaaaagaaatgccagtgtcattacaccaacatttctctttttcatccatcattcattttcccggaatcatgctctccaaaatcccactacgacttctttatgaaatcagaaagtccagtgaaaacctcgtgtctgcttccgtcattccctgctcttttaaaagtctgtggatcgtacccatataatgatctgacaataccctgcagatttcttctttcttcctgcttttgcatgcttccagcagttctttatgtatcggatattgccgtttgatcactgcttttttgtccgatgccagattataacctgtcacgatattcccataattcagacttttccatgccttatacagacttttcattccggtcattctgatcagacaactgtgaaacttattatcatatgaaaacagctgatcatattcgtccacattcagactcttcatgcgttccagtatttcttccatctcctgcagggtttcttccggtatctttcctcccagaagacgcactgccataatctcataattcgcacgcatcagatagatttcaaatgattcttcgaatgtgatctctttcacggaacatccggcatttcttacatattctaccaggccttcgttctccagttcgcgcagtgcctctctgatcggcgcacggctggtcttgaattcctttgcgagttcctgttcgacaatcttctgccccggctgcaattccctgttaatgatccgttttcttataatatctacaatactttcacgtaatgtcttgtatcttaatactgtcataacttctgttatcctgtcttatttttctaactactggttaatctgataatttccatccgaatcagcctggatatgcgatgcataaaatgtctctaccgctttcaccatatactccgtgtcctttacaccggccgtctcataggccgagtgcatggcaagctgcggtaatccaatatccactgtattcatggacacctgcgtcatcgcaatattccccaatgtacttcccccggcttcatccgaacgattagcaaaatactgtaatggtacgcctgctttttcacagatcatcctgaatactgccacactgaccgcatcactcgtatatttctgtccggcatgtgatttgatcacaatgccgtcattcatatagacgcagtttgtcgcatccgtcttctgcctgtaattcgggtgtaccgcatgggcattgtcacagctcagcataaagcttcctgctactgcacggtggaattcctcttcgttctttccaagtgctttgttcattcgccacaatacatcataaagaaatgtagatgcggccccctgttttgttcctgagcctacttcttcgttatcaaagcaggcatagacattgatattctgttcattttccgctgccaggaatcctttcatagatgtaaatgcacactgcagatcatccagtctcggacatccgataaattcacggtcatttccccatctgaccgctcccatacggttatacaagaacagatccatgccatagatatccgtatcttttaatcccaattcttctgcaactaaggatcttacctctccttgttctttcacgcttcccgataataccggtaacatatcaatctgtttattaacagctcttccttcattcactttccggtccatatgaattgcaagactcggaatcatcagaagatctctgtccaccttcacaagtctggtttcgattctttccccattcttaaccataactcttccggccagtgacaatggtctgtcgaaccatgtctggcagatcataccgccgtaaccttcggtattcagtaccgtatatttctttgcgacctcaatctccgcattttctttcagtttaaatgccggcgaatcactgtgtgatgctgtcacatggaaactgtagttgtccagttcttttccggcttttactgcaatgatactggaattatttcttgttacatagtatcttttcccaggtttgatcttccacttttctgactcttttaattcttcgaatccttcctgcttcaggatctcttttaattctgcaaccgcatgaaatgctgtcggtgcatgttctataaatgttgtcagttctgatatgatatttgtttccattatattcctcttcatcttccgttcctgtctgacaaatgtaaacggttctttactgtacttccccataatacagcaaatcgttattgcaaacaagcaccaaccgccaaagaaatccctgtttattttgcaaacataccaacgatatcttttaccatcacaacagctttatccattccttctactgtaatatgctcatataccccgtggaatgcatatccgcctgttccaagattcggacaaggaagtcctttgaagcttaatcttgcaccatctgttcccccgcggattggcgcaacatccggaacgatatctgcattctcggccgctttcttcgcatattcaatgagctgcatacatggtttgatcttttcacgcatattgtaataagattctacgatctcaatttcaaccgttcctgctccatacttttcattcagactgcctgcaatctcctgcatttttgctgctcttgcatggaatccgtctgtatcaaaatcacggataaaatatttcatctttgtctctgttacatttccattaaagcttaccaggtgataaaatccttcatacccttccgttgtctccggtctttccgacgccggcagcatctgatggaattctgttccgatcgtctgtgaattcaccagtacatcttttgcagttccggtatgcacgctgacaccatgaattgtaataaatgctgtagatgcattaaagttctcgtactggatctcaccttctgcacttccgtccagtgtatatccataatccgcaccgaatccttctacatcgaaatgcttcgctccccttgcaatctcttcatccggtgtgaatccgatacaaatttttccatgtggagttccgtctgtcaggatctcttctacaacagtcagtacttctgcaattcctgctttgtcatctgccccaagaaatgtcgttccgtccgttgtgatcaaagtccgtccttttaaatctgccagatacgggaattcttctactttaatcatctttccgcttgttccaagtactacgtctttgccatcgtaattctcgatgatctgcggatgaatattgtctcccggcgcatccggtgctgtatccatatgcgcgatcagtcccagtgcaggtgcattttcacatcccggtgttgcaggaacagatccgtatacatatcctttctcatccactcttgcatcttcaattcccagttctttcatctcttctgccagtaactttgcaagtaccagttctctgtctgctgatggaacagtctcactattctcatcgcttgttgtccatacggacacatactttaaaaatctttcgtaagctttcatcttacttcctcgctttctgcatttcatattcttattgtaaatcatcctttgccaaatgtatattggcgaatgtcgacaatataatgttcttaattttgttatattttttctttgaatttatgttaaaattcttctagatgttctaataacaactaatttatatcatatcaaagtgaggtacatacatatgaaattaatgattgcatccgatatccacggctccgcttactactgccgtaaaatgctcgaagcttacaaacgtgaaggtgctgaccgtcttcttcttctcggagacatcctttatcacggtccacgcaatgacctgccaaaagattacaatccaaaggaagtcattgccatgttaaatcctatgaaacaggagctgctctgtgtccgcggtaactgcgacactgaagtagaccagatggtactggaattcccgattcttgccgactactgcttccttgaaattgacgggcgcaccatcttcgcttctcacggacatcatcacaatccaaagaatcctccgatgttgaaaaaaggagatattcttctgaatggtcatacacacattcctgcaaatgaagatatgggggattttatctatatgaatccaggttctgtatcaattcctaaggaaggttctgctcatggatatatgatctgcgagggcggcgaattcacctggaaggatctggaaggaaatatcgttgggatttaatttagaaggcatgactacccggacctgcataaaaagtaggaagccgttcctgttcaggttccgtcggtaggaaatactaaagcgtcaaaattatgctaaaaacggtcttcctactttttattccgtgggtatcaaatgccttaagaatgaaatggcaattgcgtaacggttgtgacagcggaaggttacagtaatcagctgtcattagcggattttcaaggcttttgacaagattgtgtaccgtagtggactacaccaggttatagttccgggtatttcatttcgtaacatccgcagctagtcacgacttgaagaaaacagtataaagtggttctagtgaatgtggaatgctcttaggaaaagttagagagtcagaatctccgttaaaggaacgaagcgaacgtgtttgaggcgaacgccgagtttgagcgtagttcctttgcttttaggagattctggctctcttagtttttcttagagcatggaacctgaaccagaaccactttatactgttttcttcaaggatcgagaggccaactacgttaataaattaaatcccaatcgacttattcttctctatgccttatcttccgatatcctttctgcaatccttttaccagaagtgtcaggtatcgcagtactgcctcggttgcaatcgagaatactacgaataacatgatacacttcgttgacattcccgtaattgcgaataatttcggcaggaagatgatacataagatacagccggtcaggcatcctccccagactacaccgcggaagatattgaccggtttacagatattgaacaggatgatgaatcctacgatcaaaagtaacatcgttgctgctgtcgagatatctgtagtatttacgccaaatgtcttaccgaatacgaccagtgcgccgaccatcaatacatcggtcaggcctgccggcaatgccttcaggaatacattggtcaggaaatgtccctgtattctttctttatttggctggaacgccaggaagaatccaggtactccgatcgtaaacatgctgatcagcgatatctgggatggttccatcggataggtgatcatcagcactacggagaataaggacaacaggaaggagaagatattcttcaccaggaacagactggctgaacgctggatgttattaaccacccgtcttccttccattactaccgacggcatacatgcaaagttggactccagtaataccacctgcgaagcctgtactgccgcgtcacttccggatgccatggctacactgcagtcggcatctttcaatgccagtacgtcgttgacaccgtctccggtcattgctactgtcttgccctggtctttaagggcgtgtacgaatttacgtttctgatccggtgttacacgtccgaatactgtataattggcaaccgcatctgcaatctctgcatcactgtgaagagtcgctgcatcgacataacggtctgcatttgcaattccggcttcttttgccacttcagaaacggtcaggggattatctccggatataactttcacttctacaccctgttctgcaaagtaagcaaatgtcttcggtgcttcttttcggattggattggcaagaaggacatatccaagcggcgttaccttgccggtcagtgcttttccgtccagttctccgtcatacgtaccgaataccagcacacggtttccttttcctgcatacccttcaatctcttctttatatttatcaaaatcatctctcagcacgaattccggtgctccaagtacatgcacttcctcttcgtatgtgacaccactgtatttggttgcggatgtaaatggagttacagacccggccttttttcctgttccttctttaaaatattcttttaacgcctccatagtgatgttatcactgctcattgctttcgcaaaatcaccgagcattttcggaagttccggcatttcatcttttttataattggatgtcggaaccacatcctttacactcatgtttgtctctgtgatcgttccggtcttatcaacgcaaagcacattaactcttgcaagggtctcaatactcttcatatcgtgaagtaaaaccttctgttttgccagacgcattgcactgactgccattgccacacttgccagaaggtataagccttccgggatcataccgatcacggctgctaccatcgatgtgacactgctgcggaacggatctccgttaaagaagaagctctgtacaaacagaacaattccgattggaatcagtgcgataccgacaaattttaccagtttgtcaagggaacgaatcatctcagactgttcacctttctgcattgctttcgcttccagtgtcagtttggaaatataagaatccactccgactgcatccagtctcgcatgacactctcctgccacaataaagcttcctgacatcagacgatctcccagattcttggtaatctcatctgattctcctgtcaaaagagattcattgacctgcacacttccatgtaccacttctgcatcagcacagacctgatttcctgctttaaagattacaatatcatccagaaccagactctccgaattgacccgtgaagtctttccgtctctgaccactgttgcatgtggtgcatttagcatatttaatttttccagtgtctttttggaacggatttcctgtatgataccgatcagtgtattaaaaatgatgaccggaaggaatgtcaggttacggaacgagcccacaattatcagaagaatcgccagaaccagaaagatcagattaaaatatgtaaatacattttccttaataatctcttccgttgtctgcgccggtggatcgaccgatacgttgctccacccgtcacgcctgtgttcttctgcctgcgccgacgtcaggccttcctcataatccggctcgtatctggttgtcggtgtacgttctatttcataatcacaggcttcttcctgcagttttcgttttcgcctgtcgttttttttcatagagttcctccttatcagctgcattctactgttacattctgattttatctattattgtatttagtatacaccagaatatgccaatattgtattaacactttatgaattctgtatgtatttttgctgaaaatgcagttcacatcttcatgtaaactgcatctgcttcctctatatactcacattttcatccgtacgaagcaacgcacttttcgcaagctggtcggcctcttcgttataatgatttcctgtatgcgctgcgactttgcagaaagatatctttatctgctctgctgcttcctgcatatgtgccgcatacttgctggtaagcggtgtcttggcccgccacacgcctgtcacccatttttccacaccttcgtaatcatagcggatctctactgccggatactcatgctctttcgcccattgcactgcattcatcgcgccgagcatttctcctgcaacgttccggatcttcacgccttccggatcacagccgcttccggattttctgaattcttctccggccggtgtcaggatcacacagccaaatgcatatcttccgatgcttttttcaaagcttccgtccacataggcaatcaccatattttccggcacttcaacaattcctgctgcttctttttcttcatccttagatacatttgcagtagttgacatttgcaaaaatgccatcgcttcttctctgtctgtgaagcctctgaactctgctccggagtatccggacgtcgctttctgacactctgcccaggtctcaaataatcctgtcttatgtccttttcttactgcatatattttcttttttgccatatctattatccctttctgataatttctaagaatctatctccatacttttccagtttatgctctccgacacccgatacttccaacatctcatcccgtgtcgccggacgcattacacacataccggcaagcgtcttatctgcaaataccatatacggcggtaccttttcttccgatgcgatctcacgtctgagttcccgtaagctttcgaataattctgcatctttttctgaaagttccgctgccactgagccttttttgcgtctgttctttttctcttttgattcagatttcttttctgtctcttctttcggaagcttcatgatcagcggttcttccgttttcataaatgctttcccttccggtgtcagacagatcaccggatattgttcgcccttttcttccacatattcgcggaactgtaattcccttaatatctgtcgtaatctcggaaccgtccgctcacttaacactgcatattccggattcttatccagattcttgcccaggatcttctgactctttccgccgtgcacgatatcgatcaccgtcgctgccccgtaattccagtccagtgcatccagacaccgcaggattgtattcgcctccaatgtgatatctacctcttcaaactgtgtctggcagttcagacagtttccgcaataagaactgctcttttctccaaagtaattcaagatatattgtcttaagcattctgatgtaaagcagtaaaatgtcatctgtttcaggcgttccagatcccgttcttttacgattttacgcgtctcttcatccaactcactgttctcttctccattttcaataaacagacggttcgtccttacatcccttggctcataataaagaatgcattcggacggttccccgtcacgccctgcacgtccggcctcctgataatagctttccatatttttcggcatattataatgaatgacaaagcgtacatccggcttgtcgattcccattccgaatgcatttgtcgccaccatgatctgccgctttccgtatataaaattctcctgattttccttccgttcctcatccgatagtccggcatgatatctggtcacggaaaatccttcatttctcagatcaaagcttacctgttccacgctctttctcgtcaggcaatatataattccgctgtcatcggatgtatcgtatcctttttccttcagataactgaccagttccttatacttatccacaggcttcttaactgcaaagaaaagatttccacgatcgaacccggttgtttccacatatggattctgaagccttaagatatcaaggatgtcttctcttacttctgccgtcgctgtcgccgtatatgcaccgaccaccgggcggtatgacagacggtccagaaaatccaggatcttgagatagcccggacggaaatcctgtccccactgcgatacgcagtgcgcctcatctaccgctacaaaagatatctgcacctgctcagagagtgcaaaatccagaaagctctcggtttccaaccgttccggtgccacgtatatgatcttgtatctcccctgttttgcaagctgcagtgctttgtaatactgtccggaagtcagagaactatttaagaaagctgcatggacacccatctggttcagcgttccaacctgatctttcatgagtgagatcagcggcgagattacgatcgtaattccgttcatcataagtgccggcacctgataacataccgactttcctgctccggtcggcatgattccaagcacatccctgccttccagtaccgcttctatcacagggatctgtccctcccggaaatgatcatagccgtaatattgtttcagtatcttttctgcttctttgattgccttactcattctgccccgactccttacattctgtctttttttgtccgtttcttttctactcattacttttttaatccgcagactttcccacacccactatgttttactatcttatcacatttgtctctatctttcatcctatctttacaatcccctctttcatggagaaatccttttgactttccgattctttttcagtataattgtttcagtttttgaaataaaggaggacaaacacatggatttccgtcagatcaccatgatgcagaagataaaatcaggtatgaatcgttttcgtgccaaccacccaaaatttccgatgtttttacgcgcagtatcacaggatgcattggtggaaggaacgatcattgagatcaatgtgaccacaccggaaggaaaaaattattgtaccaatgtcaagttgaaagccgatgacatggaactttttgattcgtttaaaaatatgcagggttaattttccctgcatattttttattcagtgggaacatactaattctgtcataaatatatagcaaggaaggtatttattatggaagaaatgttttgtttccagtgtcagcagaccgctcataattccggatgtgaagggcgtgccggtgtctgtgggaagaaaagtgacaccgctaattatcaggatgagcttactggtgcactgatcggtctgtcacgtgccgtgcgtaaaaagcttgccctgaatccggatgcttctttcgaacatgcggatgaacttatcttaaaagggttattcaccaccattaccaatgttaattttttcaatgatacgatcatcaaacttattcacgaagtaaatgttgaaaaggaccggatctatccggatatcatgaattatgatgtccgccatatctgggaagatcaggaagatatccggtctttaaagtctctgatccttttcgggctgcgcggcatggctgcttatgcctatcatgcttatgcgttggattatgtagacaaaaatgtccttgatttcttctatgaagggctcgaagccatcgcttcggaaaagagcagtgacgaattacttgcactcgtattaaaaacgggcgagattaattttcgctgcatggagcttctggatcatgcaaactccggcacttatggcaatccggtaccgacagaagttccactgaccatcgaaaaggggcctttcatcgttgtcagcggacatgatcttcatgatatggaactgttattaaagcagacggaaggaaaagggatcaatatctacacccacagtgagatgcttccggcacatggatatccggaattaaagaaatattctcatttaaaaggaaactttggaactgcctggcagagtcagcagtcggaatttcacaacattccggcacctattttatttactaccaactgtctgatgccggtccgtcagagttactgcgaccgggtatttaccacctccatcgtgtcatatccggatctggtgcatatcggagaggacaaagatttcactccggttattgagaaagctctggaatgcaagggatatccggaagatcatccgatgaccggaatcaacggcgggtctacagtcacaaccggattcgcccacaatgctgttctttctaatgccgggcatatcgtggaacttataaaggccggcaagatccgccatatctttctggtcggcggatgcgacggtgccgctccaggacgcagctattatacggatttcgccaaagctgcacctatggacaccttgattctgactcttgcctgcggaaaataccggttgaatgacctggatcttggttccatcgacggtattccaaggatcttggacatggggcaatgtaatgatgcttatagtgctattaaagttgctcttgcacttgcggaagtctttgactgcaccgtaaatgacctcccgctcaccctggttctttcctggtatgagcagaaggccgtatgtatcctgcttacgttattatctctcggtgtgaaaaatatcctgcttggtccgacacttcctgcattcgtctctgaaaatgtatggaagatactggtggagaattataatattcagaagattagtactgtggaagaggatatgaagaaaatccttggttaatgatcttcaagatttgcgaagaacaattcatagaaatcatcttcagcctcgatcatcggcgagttctcccctccgccattggtgcttcttttcattgcggcatggaattcttctcctgccgcaattaattccattttacttgcgcaagctttatttcataaatgcatttacttaaatatgtttcccacagatatctgccagacagcatttctcacaatgcggcttcgtcctcgctgtacagacgtctcttccgtgatataccagcctgtggcagaaatcactgccttcttccggcgggatgatcttccaaagttccatctctactttcttcggttccttgattccatctaccagaccgatccggttacagagtctgatgcaatgtgtatccgtaacaatcgccggtttgccaaacacatcccccatgatcaggttcgcactctttcttccgactcccggaagtttcaacaatttattaaaatcatccggaacttttccaccatattcatcacggagtatacgcatacaggcactgatatctctcgccttactctttccaagtccacatggtcttacgatttcttcaatctcttccggtgttgcttctgccagtgcgttgacatccgggtactttgcatataatccttctactactacattgactctcgcatccgtgcactgtgctgccagacgtacactgaccagcagtttccacgcatcgtcataatccagcgtacagtccgcatccgggtattcttttttcaggcggtcgatgaccaccagtgccagttcttgtttatccatttttattactcctgttcatttccatccgaaagcttcaccataatataatcatgatgaatttctttcagaaatttatcaaatacatccgctgtcttcatcttgatactggaagtgttcacacatggatgacatccgaattcttcctgttccagaagttcctcatccaccagaagctgcactttattctcctgatcaaagatcagtcccatgacagtagctgaacccggcgttacattcagatatgtttccatgtcttctcccgatgcaaaggataatctcgtggtcgggatctgctgtgacagttcttttgtcttgagcgctttgtttcctggcatcaaaagcagataatatgacgttttcttcctgttacataagaacagattcttacagatctccattcccagcgctttatcaatctcttcacaggcttccattgtcatgaccgcttcgtgatccgctctgatgtaggggatatgcagactgtccagtatatcgtaaacttttatttctttttcttttcgtccggatgtgtcttccgggcgtccattgtataactccattttatctcttatcctatatcaattttcttgttccttcttttctcactattatacaattatcaatttagtactacaagtaatttccagtttatagattcgattgccacactgttttgaaatgcctgtaccctttattctcctctattccactttcagatatttctccatccacacttctgcaagctgcgtccagctctgtacttctttcagcgttttgcggattccctctttctgcttttccgtccatcttgccggctttttacgtccgataccgaacttcaccagaagttcctctcctttttcctttggaaatggagtctcgccggcttcgattgcctctgcaagcatctgcacctgttcctgtgtatatctttttccttcttcctgtcctatattctgctctaaccactcttcggttgccacagatagtccatggattccttctgaaaatacatgctgtgcaaatggtacaccagcctgtgcacaagcttgtgcaaagagataactgttctccaccggaactgtctgatctgttacggtctgccacaggaaacatggcggtgtatcttttgtcacatgattttccagcgacatatagtccagttcctgctctgacggctcttttccaaacagtgcgacaaatgaatctctgtgtgcatatttccctgaagtgatgaccggataagacagaatcaccacatctgggcggttggatatgttctggtatgcttcttccggatcttccacatctttattatgtacacaaaggcttccacacagatgtgctcctgctgagaatccgcagactgcgattctgtctggtctgatatggaattcctctgcacgtgaacgaatcatgcggattgttcttgagatatcgtgtaacggctgcatcttcagcggtgcttcatctaactgattaatcgtatattccagaacgaatacattgtaccctgcaccatagaattccattgccggcagatgcgcttccgatggggatacttcccggtatgcgccgcccggtgcgatgatcattgccgaatgcttcttttcatcctcatgaatatagctgaacatcaccggtataaagccatgtgctgccggataatgatactcttcttttttccagatttcgattctttcatttatcataatttttatcttctcctttattccttaacaattacttatttctaccgttctttccccattatacttctctacgtcttcgaaaacaaataaggatatttccgcatttgtgcaaatataatcgtttccacccgttttcgtatctcatctgaatagccttctgcgttttcaagcaattctgtcacgtctttttttgtaaaacggaactttagattcattttatataaagattcggaaatatctaattgttcatcgaatgcattacatattgttttgggctgaaccttctccataagtgtgtaaatatctcccgtcaaaggataatccatcgttgtatctgctaaaagccctgctccattatcaaagatcgggcagtatgcataatcgccttttccattcatcaagacagctatgttgtgcatatgtcggtcttcattcaggaaaaatgcatctatcgtcagcagtttgttcatatatactccaaaattctgaagtcccgtcatccgttctacctgttgcactaagaaacgtaatctttcctcatgatctggtattctatacaggcttttatacaaactttctccaaaaaaattatgaaacagcctctctaaagttataatctgccagtcttcactcagaaaatttttactttttgctccgttataaattaccgttccatattttatttcttccaggtcataacatacaaattcttgttcagccagcgtagattttttcagaagatgcgatatcatatactctgtcagtccttcatatcctgtataatcggctttgtaccagatcccatcattctcccattttaactgattcccttttgacgactgacgcctatttgtcctgatgttctgcccaaaaagttctatcattcatttacctctctatacggatccaaaaatcatcctccgccatccgtccttccgttttctctatgatcatgattggatcataaaacggcagtcccagatctttcagtatcagtttcatcttatctctgcttttcggaaaacatctggattccagaaattccatatactgattataatccggctcttccataaccccaaatgctcgaaacataatcttatctgtataattttttattttcactttccgttcccactcattcacatcaattaaagtacatacatcctgaccatacatataccatatcctgagcggccataccttttccggaactttgacttcctgctcatattccggatatttttgcagcatcctaagaaatggaacaattggcccacggataacttcttcacttctctcccaacgctctactgtcggttttgaacagttgataaattccgcaaattctttctgtgtcagatgtaattctttccggattctcttgatttcctttgctgttgtatattctggtgttataaataatctttctttcataacctcaccttctgtttttatgatacccgttttttctttattaaatcacaaactttattatttgtaaagcaaaagtaattaaaatgattgttttttaatcatcaaaaaccattattttaattgtttcattgtttttaacagctcaaacaaagtcttccgaacacatagcaagaaaaaataccaccagattccattctcggaacctgatggtatcttttcacataatttcgtattcaaagaatcttctactgcgctgccagcttcagcatcttctccagcggaagcgccgctttctggcgcatctcttcaccgagattcacctctggctgcatagtctcgagtgcttcttttacaccttccagacgtaccatcttcatattcggacagaactgtctgtgtcctacagagtagaacttcttctccggattcttctggtgcagttcatagaacacacccatctcggtacaaataatgaatgtattgttttctgactttgtcgcataatcaatgatctgtgatgtacttccgatgaagtcggataattccagaatatcgcctgtacattccggatgtgtcagtaccagcgcttccggatgcgcctctttggctttctggagttcttctttatggatactcttatgtacatggcagaatccatcattaaagatgaagtgcttctccggaagctggcttgccacgaaacgaccaaggttctcatccgggataaagaagatatctttattcggaaggttctttacgattttcagcgcattggacgatgttacacagacatcagactctgctttgatctctgcagtcgagttcacataacagactacagatacatccgggtactcttttctcacttctctgatcttatccacgtctaccatgtgtgccatcggacagtctgcatgaccgtctgccattacgactctcttctttggattcaggatcttcgcactttctcccatgaaagagactccacagaaaacaatcgtgctctccggaactttggttgcaatctctgcaagataataagagtctcctacatagtctgcaatctcctgcacttccccatctacataataatgtgccaggattacagcatctttttcctttttcagtttttggatttcatttttgatttcttcgttcatctcaaacattcacctctaaataaagtattcgatggtctcttcttccgtaagcttcgtcttttcattgaacaaaatgacgccttcccgtccatcgtacggtcaaattcccttctttaacgtattctcacttacctatcatgcaccgattcagccagttgtgtcaatgcctgttttaaaatttctcgtgggcatgcaatatttatacgctcaaatccctctccgtccggtccaaacattgctccgctgtcaagccagagttttgctttgttctccaccagatcttttaactgctcttctttcatgccgagactcttaaaatccaaccataaaagataagtaccttccggctctgtcagtttaatctccggaagattctcttttaaaaatgtacggacataatccagatttccctccagataaattttcaattcttttaaccactcttcaccggtctcataagctgcctgacatgcaaccagtcccatcagattcacctggctgtaaccggctgctgtcacttccgcccggaatctcgcacgaagttccggatttgaaatccatatattggaaatctgaagtccggcaatgttaaatgtcttacttggtgcggtacacgttgtagtgattgcagcgtatttttcatctaaggatgcaaatacatgatgtatattctctccatatgtaaaatcactgtggatctcatcactgactaccagcacgttatgtttcagacaaatgtctcctatcttacgaagttcccactccttccacacacgtccgaccggattgtgcggactgcacatcagaaataattttacattttcttcgacaatcttctgctcgaattcttcgaaattaatctcgtaatgtccgtctatctgctgaagcggactattgatcagcctcctgtggttgtctgtgatcacttcgctgaacggatagtaaaccggctgctgcagaagaactgcatcaccttcttttgtataagccttcactgccatcgcaagtgcgaataccacgcccggtgtcttgatcagccattctttttctactttccatccgaaatgcttctcataccatccggctgctgcctggaagtaatcctcttttccttcgctgtatccgtagattccgtgtgcgactgcgtcacttaagcttttctggattccaggtgctgtcggaaaatccatatctgccacccagagcggaagcatatcatcacttctccctctttcttttgcgaaatcatatttcaggcattttgttccatgtctgtccactactttatcaaaatcgaacttcatctgtgcatcctcctacgcaagtgcctgctcaagatctgcgattaaatcatctgcattttcaattccaactgacaatcttaagaaatcttctgtgattccaagtttctctcttacttctaccggcagatctccatgtgtctgaagcatcgggtaagtgatcagtgactctacgcctccgagactttctgcataagcgatcagttttacactttccagaagctttcttgctgttgcttcactgtctactttgaaagaaatcatacttccgaatccacttgcctgtgatgcatttactccataccccggatgctctttcaagcctacataatagacctgttttactttttcatgtccttttaaccagttcgcaatctttatcgcattatcctgctgtgctcttaatcttacagacaatgtcttaattccacgcaagatcagatagctgtcaaatggtgcaagacagcttccgactgtcttatatatataacggatcttcttcgctgtctcttcatccgccgaacacaggaatcctgccagtgtgtcattatgtccgccgaggaattttgtcccgctgtggatgaccaaatctgcccccagttcaatcggtctttgaaataatggtgaaagaaatgtattgtcaacaataatcttcagatcatgtttatctgcgatttctttcatctttctgagatctgtgacacgcatggtcgggttactcggtgtctcgatataaagtgcttttgtattcttccggatgcctgcttctacaagatctgcatctgcagtatctacataagagaactccaatcccctctttattccgacagattcaaacattctgacagaaccgccatacagatcatctgtacaaaggatatgatccccgcggtcgaataactccagacaaaggcctaccgcagccatgccgtttgcgcatgctacagtatctaccgcaccttccagtgccgacatcgtatgctcaagctctgttcttgtcgggttgctctctctcgtatagtcatatccggtagactgtccaataccaggatgggcaaatgtcgctgcctggtagatcggtactgctaccgaaccgtaagaatgtgtcttttcatctgttccgtttccatgtatacatcgtgtctcaaatccgtaattcattatttatttacctctttcattgtaatcatcaaggaaattatattccatgtcgtctttgtggtatccgataatggttcttaagttgacattatgaacacttcggaaaatgttcttttctatggtatctccctgttttctgaattccttgatcagctccttcatctcgtcacgtttggaacctcttccgccgccacaggatacacagttctctgtgaatctgcatgcgcactgaatgaagttgagctgattgtaatccctccatgctataatgtcatcttccttgatcagatacattggtctgatcagctccataccctcgaaattctggctatggagcttcggcatcatcgtctccacctttccgccgtagaacatccccataaggatcgtctcaatcacatcgtcgaaatgatgtccgagcgcaatcttattacatcccagttcttttgcgtgagagtatagatagcctcttctcattctcgcgcaaaggtaacatggattcttgtcaatatctgctaccgtatcaaatatctgtgtctcaaataccgtaagcggaattccaagtactttggcgttatcctgaatgatcttccagttatcttcattgtatcccggattcattaccagaaatactaattcaaaattcgctttgccatgttttaacagttcctgaaaaagttttgccatcagcatggaatcttttccgccggaaatacagactgcaatcttatctccgtcctggatcagatcgtattctctgattcctttcgtgaactttctccagattcccttgcggaatttcttgatgatactgcgttcaatctctttctgcttctctccggtagtattttcatcctgtacgaactcacttagtttctttcttaaaaaggaacgatatccgccttcaatattcgccgcatcatatccggctgcttccagttcataaacagcatcgacactccattcaccggtatggcataatacatacaccggcttttctttcggaagttcttccatacgttcttctacttctgcaagcgggatgctgaccgctcccggtacagagcctctgatatatgcatctgcaggacggacgtccagcactgtgattgtatcctgatctaattgtaataactcttctatcgtgattgtcttcatatcttttaacctctctttgtgagttgctgttcatgcagcagctattcctatcaaccagataggttttgttatttatctggtattatatgacgtttttccctgtctgtcaaggaactgaaatgtgttttaaaaacatttatctttcaaatatacgctagaaaagtttaccacaaaaaagaatactgtaccagtggtttcccgctaatacagtatgttttgttgttttctccgggcgctccctccaagcgttagaaagacctgcaatccttgtgcaagcacaaattgcaagtctttcaacgcttgtgtgaactgatgttatatataatacatatcctgtccataatcaatgtattcctgatactctttctccaaatcatgcaaggttactgactggaggatctctgtcacgctgtcatttaccctgtcgatcaccagtttctggattgctttgacactcccggtatattttccttctttcggaagttcctcatcttcgatgcggtagtcaccttccaaagcttctataatagaagaaacggtaatctcctgtggcggacggcttaagaaatagccgccctgggagccttttatactctttacgattcctgcttttctaagacttgcaaatacctgttccagatactgtggagatatcttgttccgctctgcaatgctattgagcgccacctgttcagtttttgaattgatggtcaggtcgatcaacgctctcagaccatatctgcttttcattgaaagtttcatatatatctccacactccttcattattttttattctacggctttgaatgcctcatccagatcctggataatgtcatcaatatgctctgttccgattgacagacggattgtattaggcttgattccctgatccagtaattcttcttctgtgcactggctgtgtgttgttgttgccggatggataaccagagattttacatctgcaacgttagcaagcagtgagaagagttccagattatcgatgaaatcttttgctttctgtgcgtcacctttgatctcaaatgtgaagatagatcctccgccatttgggaaatatttcttatataatgcctgctgctccggatcatcagatacagccggatggttaaccttctctaccagtggatggttgttcaggtaatctactactttcagtgcattctcaacatgacgctctacacgtaatgataatgtctcgagtccctgtaagaagataaatgaatggatcggagaaatggttgctcctgtatctcttaaaaggatcgcacggatctttgtaacaaatgctgcaggtcctactgcttttgtaaagctgattccatggtagctcgggtttggctctgtaagagaagcaaattttcctgatgcttcccagtcgaatttaccgctgtcaacgatgacgccgccgattgttgttccgtgtccaccgatgaattttgttgctgaatggataacaatgtctgcaccgtactcgatcggtcttacaaggtaaggtgttgcaaatgtattatctacaacgagcggaatcttatgcgcatgtgcgatatttgcaatcttctcaatatctacaacgtctgagtttggatttccaagtgtctcgatatagagtgctttcgtgttgtcctggattgctgcttctactgcatcataatcgaagatgtcaacgaatgtggttgtaattccgtactgtggaagtgtgtgctctaacaggttaaatgatccaccgtaaatattcttagctgctacgatatgatctccgttctgtgcgagattctcgatcgtgtatgttactgctgctgctccggatgctactgccagtgctgcaaccccgccctccagtgctgcaatacgtttttcgaaaatgtcttctgtagggtttgtaagacgtccgtaaatgttacctgcatctgccagtccaaaacgtgctgctgcatgatcactgttgcggaatacataagaagatgtctgatagatcggcactgctcttgcgtctgtaaccggatccggactttcctgtcctacgtgtaactgtaatgtttcaaattttaactctctattctctcttgtgattttttcgctcattgggttgatctcctttttcttcataattttatcgttatttattgatactgtccgttctgtttcggattctatatctttttattctgtaaataatggtgttgaataatatctgtcacctgaatccggaagtaatgctacgatcgtcttacctttgttctccggacgttttgcaagtgcgatagctcctgcaagtgcagctcctgatgaaatacctaccagaactccttctttcttagcaagaagttttgctgtctcaaatgcttcgtctgcttctgctttgtagatttcgtcgtagatcttggtatctaatgtatccggaacgaatccggctccgattccctgaatcttatgcgggcctgcttttccttcggaaagtaccggtgaagaagccggctccaaagctacgatctgaacttccggtttctgctcttttaaataagcaccgattccggaaagtgttccgcctgttccgacacctgcgatcacgatatcgactgctccgtctgtatcgttccagatctcaggacctgttgtttttttgtgtgctgccgggttagcaggatttacaaactgtccaggaacgaagctgttcggaatctcttttgcaagctcatctgcctttgcgatggctcccttcattccttttgctccttcggtaagtacgatctctgcaccgtaagctttcaggatgtttcttctttccacactcatcgtctccggcatcgtaagaatgattctgtatccttttgctgctgcaatagatgcaagaccgattcctgtattaccggatgttggttcgataatcacagaaccttcttttaagattcctttttcttccgcatcttcgatcattgcttttgcaattctgtctttgacgcttcctgccgggttgaggtactcaagctttacaagaagtgttgcttccagaccaagttctttttctatgtttactacttccaccagtggtgtatttccgatcagtcctaatgttcctttataaatctttgacattttgcttcctacctttcctacttttttggtatgttttcttgatgaatttactatactaccttaattcctatttgtcaactatgtttagtatgtttttgtaatttttatttttcatgcgcgcaagcgcaacaacatcgcattcgtccccacattcgcttttcttttgtcattatcctgcacgctcccttccgttctttaaactatataaaaccaatccttatatttcctactgtttcgataggttttatagattggttttattatattaccgctatgtcatatttgtcaagtatgttttttcagtttttcacacactctctacttcctgtaacttaggtattcagcgaacatatcttcaaatgtttttctccttgcctttgatacagacaagatttcattattatccatcttaatttctgactttttcacttctgtaatataccttgggtttacaagaaaacttttatggattctgcaaaaatattctcttcttaattcttcttctatttcctggattctttttcttgttcttaatattttgccggtaccattctgcaatatatgtatttcacatcctcgtctgataattgaaaaatacaggatttcatctatatctattttctgatacataccatcatcttccgcaataaagtattttttccctttctgttcttttgtatatgttagtattgttccaagttctctttgaatttctgacggattactttgttttaataaatatctgtatggctgcacacagaagctttctggtgtaggcaggtatatgccacttacaaatacaagaattaaatctttatttttcttcttcattatttcagatgctttatttccggaaattcccggtaactgaatatctaaaaaaagtaaatccagatcattttcttcatcctgtattaatgtttcacctgtcgaatactcatatataaagctttcactatcttctcttcggatagcttctgcaagcaatgtccggaagtttttatcatcatcacaaattcctatttttatcactctatgttccccttcactgcataatcaaccttatatttttaccactttatcacataactccgcaatttcccaatcgtggctaataattataataattttgtcttgtttaatatcttgcaaatagtccataaccctttctttactcataacatctaacgctgacgtaggctcgtctaacaaaagaacatctgcagttttaataaacaaacgtaccaatgcaattttttgtctttctccacctgaaaattcacttttaccatcaatgatttttctttcttcatcattgtataatcctaataatatatccagcaatgttgttttaccagatccattttatcattatttttcctttactttattacttaaacattttattaaccatttaaagaaaagatacagatacaaacacaatgaaaagcttactatcattgtttccatatctatttttctagaaatcaatcttccaatcaaatttccattttcctgataaaaggtcactccatttccataatctgcaccaatttcttctataagcaactgcaacattctatttttacaatttgttatttttttgaactttatcgttgcaaatttatcgttttcaaaatcacttaccgaaatttccttttgtctcagattttgctttgtctttttgtctaatattgtaatttttatttttatattagtgcagtctccgacattctgtgttttaacctgtattccatccaacgatttttcagtagaatatacatcctgcgtaagttttttttcacatataacgccagtatttgaatattttcccacatctactgttctattgtaaaagtattccttcttgtcaacatgcgcatataaatatgcaaatatcatacacacaataagcacgataatagttcctttatattttctcatattcttcacatacttcccttgtatttccatacattctcacttttccatgatccaaccacacaattttattacagattttcttcacctgttcaatactgtgtgacacaaataaaaccgttgtcccactttcctgcattttctttattcgatcttcacattttttctggaatctaaaatccccaacagacagtacctcatctacaatcaaaatatctggtattccaattgttgcgatagcaaatgctaatcttgataacatacccgaagaataattttttactggaacattcataaaattttctaattctgaaaattcaacgatatctctatagtttttcttcatctcactttgagaatacccaagtagtgctccgttcaaataaacattttcttcccctgtcaggtcaccatcaaaccctgctccaagttcaattaacggcgcaatctttccttttacttttactgttccctgcgtcggcctcagtatccctgcaatgatcttcaatatcgtgcttttcccacttccattcagtcctataagtcctagcgtatcaccctttttcacttcaaaactgacattcttcaatgcccagaaggaatgataagtaatttgctgctttatcatctttataatatattctttgaaactgtcatatttttcggatgacatattgaattttattgatacatcttttacttcaacaaccgtctctttcatattcactcctacttatttgctatatatccataataaatttatcctgtctctttccaaaaacataaattcctattcccagcataataaatgtttccaacacaccaactccaagaatttttatcgaaatattttcttcatacaatacacattcacggaaaataattaaaaagtgtgtcagaggattcaacataacaatcttttgaacccgttccggtaaaaaggacatggtataaataatcggacacaaatacataagcgcagtcaaaaaaacggaatacaaatgcatcatatctctaaacttaactgcgatagctgataataccagtcccactcccgttgaaaataatgttaataaaatcaatgctacaactccttcgtaaagcctatagctcagatcaattcttaaaaccagcataacgcaaaacaaagcacttagcgtcgccataagattaatcatacttgaacatatcctcgcaagaacaaacagatatttcggcacatatattttcttaatcaacgacgcattatccacaatcgcagacattgacgatgttgttgcctcagagaaaaaattataaattaactgcccgctgaaaatatatgtcgggtaattttcaacattatttttgaagagagttgaaaaaacaacggacaatattatcatcataaaaagtggattcaatacgctccacaatactcctaataccgattttcgatattttacttttatatctctttttaataattcaatcaaaagcggtgtatattgttttatttcattacttttcatattcctttttactccattcatttaccagttgtaataacttctgataattgtactttacagccggacatgcctttttttcttttctccgtaataccggacaccctcccatacatattggaagtattttacattctttacattcatccggaatttcataacttatccattctacaaatttttcattttcacaatccaaaggatgtaaaacatctcctattttgcattcatcttttgcaatgttcatctaaagccagaattgcgccactatataaattgttaaatcaaatattcatctccacattttattatttcattaaattttgataatctcattctaataaatgcctcctattccaatcatttcttttattatcattacaaatattctaaaaactcttttattttcttaaacgtactataaatagacaattttattcgtttatatcacttattttctttcatcatactaatttcgtttaaatctttaccattaaatctgtttcatgcattttcaagtcttactgtattattctttattgcgaggaagtgatacaaatgaaatggttagtaacacctgtaaattctaagaagaaaccacatggctgtgccatttacgttcgccaatgtggacataaaatgtatgtaactttttaattccgctcaaaaaaaagaaacagctgcttgcaactgtttcttttttacttatcctttatttttctcttctatatttcacacccatataatcagaaaatttctcatgaaatttctttgctttcattctggaaatctgtattttctgaccatcttccattgtaattatattattttttatctgaacaatgtagttaaattgaacgatcacacttctatgtactctatagcaagtttcctgatccattttttcttcaatttccctgatattttctctaaccgtaattgtttttattttccgttgcttttcctcattctcataaaatgttatttttgaatgttttccttctgtcattacatataacaaattgtcactatgaatccatctttcttctttttcgcatgtaactttcaatattttttgattccgtaatttcatttcatgcaatatatcatctatattccgatcccaggattggttcatttcctgctttagcaaatatctatatggctgtacctgaaatgcctccgttgtcggcagtatggtaccggaacaataaatcaacagaattaatggattcattctatataattcttctgcaattgacatcccgtctcttttcggcagaacaacatccataaaaattacatcgaagaaatgatccatttccattaataactgttccccagaatggtattcataaatttcaatctggtcgtctgatctgattttctccttcaacatagttcttaattgttttataaagaacaaattatcatcacaaattgctattttatacactgtctgctccttttatctcttgtatttgggaataataactcttacataatagacgccatcttcatatttgatattcaggaatccctggtatttcgcaacaacattttttacatattccagtccgattccatgattttcctgattttttttggttgaaagaaaccttgttccctttttcagcggtgctgtttcgcttgtattttgaatattcaatacgataaaatgattgttattcgaggtatatatatctaatgcaacactcttattatctctgcattttccagccgcctccatcgcattatctaaaaggttaccgagaattccaattttgtcgatatcatccaaaaaagtcagatctgctgttggctctatattaactctgaactctatatttttatttttagcttctccattcttttcgcttactacaccgtttactattttatccgtgcaaaaaatttccttagtaacatacaatgcctgcttttccatttcttctataatattgataacttcgcgattgttattctcattcacaagtccggctatcgctttcatgtaatgttctatattatggatgtatttccggttttcatcattgactttttcaagtttccgataataatccgtcgaatagatagctttttgcatttctctttcctgcattcttatccgccctgtgtattcttcaacctttacaaaagccagaaatgcaagcataaccagtaatatcagtaaacacagaatgatacttcccagcattgcttctttcattgaaaagcctgatcttccggatacataaagcgtaattccagcaattatccacatatatacaaaccatatcaaagtcatccatccgataattctggaaaagattttatctaatacttctacatgctttgatatatatctttttaacaggattataatacatgtcagcaaaacacatctgagtatcataataccgacactaacataatccatgatattttcaggaatttctttcattaacattaacatagccagagccagttgcaatccataattcaatatataaaaaaataaactggctactatcatagtctttttcgttccattaaaaaaaatattacacaatatgaaataaacaaatggcatgtataataatttaaatgccgaaataactccccaactactaaagtaataaataacagccaatatgattccacacagccataatggttttctctttttattgcttttatctaatgtgatatttaagtaagccacataaacaaatgccaaatatactgcgcatataatcgttattccattgtagattatctgttgcatatttacctcttaattttctaagtttatatttctgcagactatattatcttactgtttggacaacatgtgaacaatacctatattataaatcaatatatttatattattcaagtcccccaaaagcaactaaaaattatccttgcaatattcaacaaccattctacttttacttctataaaagctttatctgtatatcaaatcaataacatttaatattccataacgctctgcaataatcttcagtccttttttaattttttcgtgactataattcttcgacaataatgcatcttccgtcagttcatttagatatccatagaatacaagcgctttttctaaagctccttctttatccgcatctacaagcgttaatatctcctcttccaccttcttaatgttatctataccactttgtccgtttgcagcttctaacatttttttgttttcgcttttaattgttccctctgaaatatttacaggtacacctgtatccttgtttaataataacttcaccattgttcttataacttcattattcattcttattatataatcctgctcatacatatatttcactcctccgattattaaatcattccaaaactggatgttccgaaattttaatactagtgtatctccgaaaaatactttctctaaaatattatacatcccggtatcttcccgtgtacacttttatatcacaaaagctgtctggttagcataccttcataacctgacagctttttttttctaatctcttatattttatttttctgaaagcttctctctcccatgtggaagcagccatgcttcttcattcggtccctttgcaatgatctgatgaatattttcaggattgcagtcaatgtgataatgctttttgattgccgcaaaatctgtcgtatccccgaatcccggtgtctgatacaggtctcttgcataagcccacagattatcataatctctcagacgcttcttattcacgcggaagatattgtgataagccacatcgaatcttgccagtgttacatataaccggacatccgattctgtaatcttatctccgaacagatatcttctgtcggccagtctttcctccagccagtccagacggttgaatacggtatgataagcttcttcatatgcttcctgacttctggcaaatcccgctttatacactctgttattcacttctctgaaaatgatatcattcagggctttgttctccttttcaaaaacacagtactatcctattacataaaatgtcgttccgtcttcatatgataaatgacgtttctatacagcctgtgccttgcttccttttatcatttctacaaaatatgcatgcacacttgtatcatcattcagttccggatgaaacgcagttgcaagctggctgccctgccttgcggccacaacttttccatctactacggcaagtatctctgtctctccgtagacatcgtcaatatacggtgcacggatgaatgtcattggaatctttccaatttctttcatctcatcttctgtataaaagcttccaagctgtcttccatatgcattccgctttgccaaaatgttcattgtgccgaaacatggaacaccaccttctacctgctctgccaaaagaatcaatccggcacaggttccgaataccggaagtccgtcttcaatcttctcctttaatatatcgtaaatatccagctcgatcagaagctttctcataacggtgctttccccgcccggaaggatcagtccgtcaaaagaacgatccagatcttcttttttacggatttcgaaatgttccacgcccaagcggtccagcatctgtccatgttctaggaatgctccctgcattgccaagattgcaatcgtcattttactttcctctttctgccattaataattcaatttcctgttcattgattcctaccattgcttcgccaagatctgttgaaagttcagcgatcagtttggcatctgtgtagttcgtaactgctttcacaatagaagccgcacgttttgctggattacctgacttgaagattccggaacctacaaatacaccttctgctccaagctgcatcatcagtgccgcatctgcaggtgtcgcaactccgcctgcagcaaaatttacgaccggaagtttcccattttcatgaacatattccacaagatcaaccggaacctgtaactgttttgctgcttcgaataattcatctgctcttaagttctggatgcggcggatctccgcattcatggctctcatatgacgtactgcctgaacaacatctccggttcccggctcgccttttgtacggatcatggatgcaccctctgcgatacggcggagtgcctcgccgagatctcttgcaccacatacaaatggtactttgaactcttttttattaatgtggtaaatgtcatcggccggtgaaagtacttcgctttcatcgatataatcaatctcgattgcttccaggatctgcgcttctacaaaatgtccgattctgcattttgccataaccggaatggataccgcttcctgaatgccgcggatcatcttcggatcgctcatgcgggatacgccgcctgctgcacggatatctgccgggattctttccagtgccatgactgcacatgcacctgcttcttctgcgatctttgcctgctccggagttgttacatccatgataactccgccttttaacatctgtgccagctgcttatttaattcatatctgttctctttcataattcctgtacctttcctatctgttttctgtgaattttctttgagtcttatcatacgctcatctggtattttttaaacagccagttttcatgtttttgtgcatgccaattttgcataaaaaagaccttttgaaacccaacgttttcaaaagatcctttttagccttctctttaattaaaatcattctatttcaaatgtcttatttttcaagcccgaacgtttccacaaccacaatccagacacgataactaataaacctccgcctatcatttcaacttcatagactacattttctttaaaagttgtcataaccggaagtgccgagcacacaatcgcaatcacgcagattaccaattccatatacccaagaaagcatccccactttttattttttgtcatctgatacaacccaggtttatcaacctttttccgtttaattttaatatatgccgcaaacaaaagaacatacggaaacaacgatgtcaacgcggtcatagtaattaatacattgtaaatcgtttcaactgccgggaaaactgccacgcctgcaagcagcagagaaacaagtatcgcctgaaataaaatcgccttctccggaatgtcatgctcatttttcttcgtaatcttctccggaaagattcccggttcagaatatccaaacaacatctttgtcggttgcgcaatatacagcactaccgctccaaatatcgacaaagtaattccaaatgctacgatctgaacaaaaaattgaggaactttcaggagattgcaggcaattactaatgcatccaaagtccctgtatacgcaaagatttctgacgtcggcatcagcattgtcatacataccgaaccaatcacatataatacgcagattgttccggcagcaatcatgattgctcttggataatctttctgaggatttttcatttcagaagcgaagtttgctgtaaattcagctcctgtatacgcaaatgtaattcccgaaattgcaaccagcgaattcatatttagcttaggggtcaatgttgctatcgtatactcagatgcacttggtgcctttttgaacactaccactgccagaattgccataccaatcagacacaccgtcggtaccaccgaacccagcgcacctacactggtaaagtattttccaaatttcataccacgcatactcgcaaacgacaacgcccagaaaacaaccaacgacataatcaatactagtattttgttatctgcaagttctggtttcccaatcatgtaagtaaaattgattgagaaaaatgtcagaaaagatgcataccagaaaataagtgccgtccaatgcatccaggatactaaaaatccatattttgttccgaatgcaattttaacccagtcattcagacctccatctgtaggatatgctgttgccagttccgcacacatcagcgcctgcggcacaaagaatatcagcataaatatgatccacatcgggattgctcccaaccccaggccaaaactgtctgaggttgattttgcaatccagcggattccataaagggcagatacattcataagcacaagttcccagaatgtaatacttttttctttcaatcgcctcgcccctttttaaattccatttctctttactttgtagtcataatctctgtggaatacgtgttcatcattaattgatgcatccatgtgtccggtaatatagaagttatctttatcagcagtctgagtaacaacgatatcacaatctgtcagccatccatcacggccgttcttcatcttctgcgtaatagtatatttggctgacaacggatctttgttgctcatcgtcagttctctcttgaggttatgttctactaccgttccaatatcatcaaagcgatagataccctctccaaacactccaccaacaccgtttgtaatagatgtccatgaatccgtgagcagatcatactcaattgtacggtctacacgaccaggtgataatgttgtcatcggagtaagcggcgcacatctggcttccatattcggaccttccgcatcttttcctgagaacatcggtaatgcaaatttagcagtagacagatccagttttaatgttgcaagctccggtgatggccagatcattggccagaatgagtttgcaatagaaagtctgattctgtgtcctttcgggaagttatgtccacacacatccaactgtacttttgctttatatgtcttaccttcttcaaggtataccaccttatcatgcccctctaaatgcgtcagattcataagtccataagaaactcttgttgcagctccatccggatggatatcactcagctgagcatacataaatgcatttggcttatcgcaggtaaactctacctcaaattccggatatccaagaatctctacttcttcctctaatatatccgaatcaaataccattgccattccatcatctactctcatatctgccggagactccccgagaacacctgctcccatccactcatttgccaggagtccgtgatttggaagtgtgcaaagatctacgatttctttctttgtatttgcttcatcctgaagatgtccgtatgtcatagaaagtgttttcatagcaacatcttttgacggccatccgtccaatgcaacccagcgtccatcactaagcggatgtacagtttctggttccatgctgtcttccaaccacacctgtaccatcgggcagtctaatgtgtcgttatcaacacctttcagccatttatcccaccattttgtagcttcaccaaggaaatcaattgccggctgaggcattccgtcatgagcaaatacatgtgcccaaggtccgatcagtgcttttctcggaacacttaatccttccatcaaagttaatacactgtttgtataagaatcagcccatccatccagtgcaaatacaggaactttaatatcgtcataattcacacttacagagccgtgtttccagtaatcatctcttgtctgatgttccatccagttagccggccaaagtggcatttcctccaaacgtttaacagactcttctttccatgtatccggtttgatctccgaatcaatcgcgcggcacatgtatgccagcataatattgccccaccagaagttatcattcaacaggcatccacctttataatgaatatcctgtgtatatctgtcatcaacaaatcctacacagatgatcgctcttaatccttttggctgtcttgccgcaacctgcaatgagttaaacccactccatgattttcccatcattccgacatttccgtcacaccatggctgctcggcaatccattcgatgcattctaccgcatcatcctgttcctgtttcaggtattcatcatagaaacactggtcagactctcctgctccacgcatatctacgcgaactacgttatatcccatacctgcaaagaaaccatacatcggttcatctcttccacgcattccatctctcttacgatacggctgtgtctcaaatattgtaggaaccggtttatctgtcttaggatgccagacacgcgccgaaaggcggcagccatcagacattgtaatccattcgttctcgatcacatcccactcgtaaggaaattcatctcgcgccattactctttttactgttgattctactttagccataatttaaccctccttcttttttattatgcttctgtagcatctgcttttttctttccatacttttttgtccagataatcgcaacgattaatccaatcacgcccatcgcgatcatatacaggaaattcaggtgatatccctgatatcccggataagtatctaacaatttacctgcgattgtataactcaaaacttccggcaaatatccaaatgtggacgccataccaattgcaactcctcctaattccaccggaataccaccttctgaaataaacgagaagtacagaccaaagtttataaacatacctgcatataccagcacacaagccgccacaaccaatatcattctgctatccgaagccattttgcctgtaacgtccatgataaccacaccggcgatcatcaaaatataaccaacaatcattgtatggcttcttccgaatttatctccggaaaatccaccaagtgttgccgcaaacggacggatgtactgagacataaccgttaagattgctgcgatcacagctgtaactccgatgatattacttgcataaggagtaaaataatatgatgacatattaaaagtataacttgtgtacatcatgataataatcaaccacataaccggcatctttaacactctgataatatctttaaatgaaacagtgcttgaagttccgtcttctttaacggtctcaggctccttcaacaggaaaataaagataatacctacaatcaacggtgccaacgaatagaaccagataattcctttaattccgagagtcggcattgcctttctctgaaaaattccaaaaatcgctgttgccactgcaagatgtgccgcattgaatacacctcgcccaccttcaaaggttccataagcacggctttgttcctcctcagttgcctggattctgacaatcttcataagcgcaggccagaaagtcaaaagagatgtaacaccccataatccatagatcactaccaatgcatagaaattattaacaaacaaatgaagcaatccacccaaaccagttgcaatcatcgaaaaaataagcagttttttcgctttgattttatcggccaatactccaccgataatataagaaaatacacccaacacgccgtaagcacttcctaaaagtcccatctgcgtattagtcaagtgatacattgcctgatacgtatcatagtaatatgatcgaaaatatggcaatccataaataattgagccggcaaaagataacaaaagaatggttcctatattcttcttgtatcctacttttgcttccttagacataatctcctcgcctccattcagctttataacgttttatgagtactcttttcattaataattattgcacattgataatctattcacaaatttatctagtttcttcattcgacaataatttttactattattttcattatacgaaaattctatttagaaaccgcagcatctgtctattacttttcctatttttcatctattttcatacatttttttcatattacaaaaattgtatgaaaatagataaaaataattcgcattaaatttattgaatttaaagcatcttcctttacgatggagtaaaataaaagaaaaaactttgtcgcaaaggaagaaaaatgaacagagaacaggaaagagccaaaagaagaccggaaaagaatccagttgttgaatacaataagattcaaaataaatattacccagagttatttgccaaatttgctgaggtgaatgatccgcgaaatcaaagttatattgaatatccagtgagggttatgcttggaaccatgtactacaaatgcataagcggaatttcaagtatgcaggaaatgacactgaaatttaatgatgatgcagttgtagaaaatctctactcattcatgagtgaagaaaagaaggagtatcttcctcatggtgttatagagaatgaatttttggcaagactgaacccagaggaactggaaaaaatacagaaagatattgcttattctatgatccgtagaaaaacatttgatgatgccagggtgttgaaaaggtggcagatcattattgacgccacagaactggatgagggatatcagaaaaagaatgaatattacctgagccgctgctataaccgtggagaagcagatgaatttacgaagtatcacagaagcgtgctcgaagcaaaactttatctggggaataaccttgtatgcagtatagcatctgaagcgatccagaattctgaggaatatatcaatcagagtgaaaaaaaaaataaaacaggactgtgaaagtaaagcatttatcagagttgcagaaaagattaagaaacagtttccgagacttccgatcattataacggcagatgggttgtatgtcagtcagaaagttatacagacctgcacagataacagctggaattatatcatccgttataaaaagggaagtgcatcatccatagccaaagaatatcagtcattgccggaaaaagaaaagataggttcagaaatagaatatcagaatcagattatgtttcagaatacagatgtaaatctgacatattatacagaaaagaagattaaaccagatgaaaaaaaagaaacaacagagtttgcatggattgcagacattacaatcacaaaaaacaatgccagaaaaatagtaaatgcgggaagaaacagatggaagatagaaaatcagagattcaaccggcagaagcattggcgggggaatatagagcatgcatgcagctggaatgaacaggcacaaaagaaccattatctgatggagcagatagcagatttcataaagcagctttatgaatattattacctgaagaaaaatgaaataaatttacctttcaaaactaacaaaaattttgcctagtagcattttttatcagaatatgttagaatctttttatactttttagtttttatcaactaacattatcaaaaaacatcaaggagggataatatggattcttgcgatttttacacaacacttggcaaaaagcttcgggcaagacgccggaccaaacacatgaccttaagtgatctctccaaaaaattgaacaaaagcgttgccacgatttccaaatacgaaaaaggagaggttctcataagtattgacactctggtagacatttgtcagattctgaatatcgacatagcctctctgctccccataacttcaaccgataaaagcgcagccgaaattgcaaggtaccagaattatttttctgacaaactttatctttattggtttaacggagaaaagaactgcttgcagaaggcagttctggaaaataagaatttgtcattaactgctacgatgtattacgatgtcgatgacatatccaactactacgaagcgaattatatttacgaagacgatattacctacagcgatacatgtacggtttttatccttgtaaatacaaagccgccttttgacattctgacgttgcgtcttccgtcaatcggcattaattccatgcacgttgtcggtctgatttccacgattacgtacttttatcagagtatcgccatgaaagtgattgccagcgaaaatccgctaccgcttaatgatgaattgaaaaatgctcttcacatttcttcagatgaattaaagaatatcaaacgtacaaactttttctttgcacaatagtcaacaaaaatagtctacgcctattcaactcccctgcccctcgttcgagggcactgaaaaagtagattataccgttctatatttggtacaatgtatctatcaaatataggcggtgtttttataatcgaacaacagcagaaattggtgctaaatctctacatggaaatatatgaattaataatcccaaaagataatcttctccggcagataaaagaattggttgattttagctttatttatgatgcattgcttgctaattattgtctggataacggaggaaatgcagttccacctatccgaatatttaaatatcttcttttgaaatcaatttacgatttatcagatattgatctggttgaacgttctaaatacgatatgtcttttaaatattttttggacatggctccagaagatgaagttataaatccaagttcattgacaaaatttcggaagttacgtttaaaggatatgaatcttttggatatgctgattgccaaaacagttcagttaacattagaaaaaggaattattaagtcaaaatacattattatggatgcaacgcatacaaaatcaaaatacaatcaaaagactcccccgtcaagtactccaggaacaatcaaaaaaactgcgccgtagcatctatgaaattgatgaaacaatgaaagaaaaatttcctgataaaaacacagatgattctttagaaaaagaactaaaatactgtaaacagcttattgatgttataaaaggaaatgaagaaatttgcagttatccaaaagtgcaggaaaaattaaaatctactagaagaatctgtcactgatgacatggaacatttagaaacttcaaaggatgaagatgcaaaaactggtcataagacagccgatacttcattttggggatataaaacacacatagcaatgacagaagaacggatcatcacagctgccacaatcaccagcggcgaaaaaatagatggcaaagaactgccaaaacttgtacaaaaaagtaaagctgctgggatacagattgaatcagtcattggagatatggcttattctgaaaagacaaatatcgaggcggcaaaaaaaggtggttatgaactgatagcaaaattaaatccggttattacacaaggtaaccgaagaaaggaagatgtgtttgaatttaataaagatgccgtcgcatctatcgaagtttcaaccaatggcgaactgctatcctttcttcctttggttacgaccctttgaaataccctgaatgcaaccatcaaatggaatttttagaactctattacaaccaccaacgcgtatccctccaagaactttacgagaaatccatgtccaaatctcgtggaaagcgttcttctgcataattctttttcgattatctgtgttataatcctctaaaggaggaacattaccatgaaatctaacattgaggaattacgcaaaaaaatataaataatccacctgaaggaatgacatctatggacattcgcaacatgagcgaagatgatcttctggatatggattatttcttaaatgaagataatctgtttgatgacgaggctggtgtagaaggtttttacatcttctaaatcggtgtcgttctatctgtgtgcccgcctctgtgcgggctattttcgttcaatggttcgcccaaaatcgaactttcctataaaataaaaaatacagcagacttttgcctgctgtacattttcttgttttttattcatttacagatccagcttgccgcacttctcttcatgattatttaccaaatctgcaagtgtcacactatccacatactggtcgattactttcttaagtccttcccagaactcaagtgtggaacactgatcctgtctctcgcagcgattcggcacgtcatccagacacgcaatcggcgcaaggcttccttccgttgtacggataatatctccggctgtatattcttccggctctttcgccagcatataaccaccgttattgccacgataacttcttacatatccggcctttgtcagcatcggcataatctgttccatatattttaatgtaattccctgtcttgccgatatgtctttcagacgaatatattccccatttgcattctctgccagatcaatcataattctcagtgcatatctgccctttgttgatatcttcataatacttcacctttcatccaggtctcttctcccggttcatctcctacttaattactatgatatcacattttttgacaaatgccaatcctccgaaccattcgtccgttatcctttttcgccttttttaatcctggaatgtcttcaaagcatcaattgttctctgaatcagatcttccagtgtccatccaagcatatccgctccgcgttcgatgacttctctggaacatcctgctgcgaaattcttgctcttgtattttttctttacagactttaatgtcagatcctgtacactttttgacggacgcatcaatacaacagctccgatcagacccgtcagctcatcaaccgcatacaatactttttccatctcgtgctccggtttgatatccactgtaatcgcatagccgtgactcgccgttgcatggatgatcttctcatcgattccccgttctttcatgatctcctgcgatttgatacagtgttcttccggatatttctcaaaatccagatcgtgtaaaagtcctacgattccccagaaatcttcctcatccgcaaacccgagctctcttgcaaaataacgcatcgtattctctaccgtctgtgcatgcaggagatgaaattcatcctggttatattcggttaataattcccatgcttcttctcttgtcatatggcagtcctccatttatttcatgttatttttgtgttcctttattatatgaacatagctttcttttcctatatgttttatatgatatcacagaactgccatttgtcaatcagatattggatctactttattttatacagagaatacattgcaatggaatcacttagtttttgtcagaaattttttgtaactgctatcaatcgcaaatgcgccaagcggtgcagtcagtacaattgcaagcactgctaccgtcagaaccacatcgccacaggcaaatccaagcgccagtggaattcctccgattgcagcctgtacggttgctttcggtgtgtatgccatcatcgtaaataacttttcttttccattcatatccgttccaagcagacatacaaaaacccctgccattcggaagatcagtgcgccacagattaaaatgactgccttgattcctacataagacagatatccgatatttacagtcgcaccgaccagtacgaataagaatacctctgctgccacccataattttccgcatttcacagatatcctttttgccaccggttccctgtatttctgcagactgacaccaagaaacatcaccgcgatcaatgcggaaaatgtaattgccgttgtcatatgatcttccgctgctaccaataggaaggaaatactaagcatgatcaatacctttaccgtatcacggatatgtactttttcataatattttgcaagaaaccagccggttaataatcctatgacaattcccagaatgatcgataccggaatattcaggaaacttaccacggatacgccttttccctgcataattcccgtaaatgtcgtaaacagcacaatcacatatacatcatccacggatgctccggccaggatcaactgtgggattccttcctccgtcccatatccttcttccattaatttcaccatacggggcacaacaacagccggggaaactgcggcaagaacagaacctaagatcgctgcttccaataatgaaagtccaagtaatcgcggtgccagaaccagcatacctaaaagttcaaaacttgccggcacaaaacacatcattaccgcaggacgtccgattttcttaagtcccgaaatatcaagtcccaatccggcccgcatcagaatgatgatcagtgccattttgcgaagttccgacgaaatattcaggatattttcatccaacaggttcaacacatatggcccgagaacaataccagtgagtaacattcccagaagtcccggcaattttaattttttacaaatccagctcatactcataccacagagcaggatcagtgcaatacttaataacataaaaattccttcttattcatcttttttaaaccaggacaaaagatctctccgcatcagtttctccatcagattcagattcgggtccgaatgctccaactctctggaatagcggtataccgtatctaccacatcttccatctccagcatcttctcgttcttcagccactgtgccatcagaagttcatggatcaaaagtacactgactacggccatctgtaccttcacatatgcctctccgtcatagactgcaccgcagaaataggtactgatgaaatataccagaagctgctcataccagatctcataatccggcatgtgtgtattcagccatgtgtggaattcctgcttattctttgtatactgttctttgtactttgtacattgttcttcactgtcgctgcaaccaatatctccgtagagtaaactttctgcctcaagaagatgcggttcccagtcatcccttaagcgttccatcagatactgattccggaacattttcttaataaatgcatagttctcatcttctgataattttgcttctacaaactgtactgccttctctgtctggtatttttcaaatacatcatcaattgaaaagatatcctctcttttgatccgcacctgcaagtcatgtgcaattgccaataccagccccacacgcaaatccagcttcttatctctgtcctgaagaatatcgatcatcacttttcttgcatctactagttttgaatacagaaacgggtcaaaatcatcatattcttcttccttgttactttcataagtcagaaaacgcaccggttcctttttaccaagcagaattcttgctacctccggacaggatacagacagcgtcatctctcggacatcttcgaattcttctacgtgtctcggatacatcttgcaggtccggcacaggcttttctctccgagcgcagtatacatatcacagagattctcatcatttaaaaaggcacatcgcttattcttgtcctgcttaaatgttccctctttccagttaatggaccgtcttaatctttttctgaaagatccggttgcttttttgtattttttcagtgccgcctcatctgctacgatctgccagccggcacagcaggtatcttcacattctcctgcaatacaggaaaattcatgataataatccggaattgtatataacattgattcttcctccagtttttatacaaaatcaattcaactttgagcattataccacataattttttctaaaacagccatttcgtttgaacaggtgcaaaaagcacaaaaaagcccccgggcactttaggaggaaaagcccgggggaatcgcataacttacattagtatataaatggattctcaagaatttatttttattattatctcagtttatttaataaaacttacatgcttacagatctcttctgtagcagcatctttcttcttattgtattcaacctttctttcttcaaagaggttgtctccgtttgcatcgatagaaacgatcaatggtccgaattcttttacgcggcagttccagagtgtctccggcataccaagatctctccactcggctcttacgatctcttctacttctgtagcagctactacagcgttacctgcagggaatacgcagtggattgctccgaattctttacatgcacgctctgtattttctttcattccacccttaccgatgatcacacggacaccagtctcttttacgaattcgtactcgaatttttccattctcatacttgttgtcggtcctacagataccatttcgaatttgtcattttccagtggacggatgatcggtcctgcatgaaagattgcgttgtttcttacatctacaggaagttctcttccttcttctaccagacggcggtgtgcaacgtcacgacatgttgtcatgcttccgttcagatatacgatgtcaccgatcttgatatcttttaagtcttctgctgaaacaggtgttgttaagatttttttaccgttctttacttctaccattataattctacccccgtatgtgttgtgattgtgtagttcaggtccttatcaaatacaatatgtcctcttctgtggctccagcatcctacgttaacagctacaccgattgtagatgggtgacgtgctgtgttctcgatattaacgcccattacagaatattttccgcccataccctgtggtccaaggccgattgcattgattccgtcttcgagaagagtctccatcttagctgctctttcgttctcattgtgtgatccgatcggacgcatcagtgctttcttagaaagaagtgctgccgtctcaacagatgttgccacacctacgccaacgagaagcggagggcaggcattcaatccgtatgttgtcataacgtccataacgaactttgtaactccttcgtatccttcacccggcatcagaaccatagcttttccaggaagagtacatccgccccctgccatgtatgtatagatctcacatttgtctgagtttggaacgatatcccagaatacagtcggtgttccttttcctacgttctttcctgtgttgtattcatcaaatgtctctacactgttgtgacggagaggtgcttcaaatgttgctttcacaacagcgtctttcagaagtccttccagttcgtcgataagtgggaattttgttccacattttacccagaactgtaatacacctgtatcctgacagcttggtctgttcagttttacagcaagttcctggttcttgaacatggtgtcataaattacctttgaaagcgggctgtcttctttctcacgcagctctgttaatttttcaatgacatcatctggcagtttctttgcgatatgtgcaataaattttgccatataatctgtaagttgtgttacctgttgttctttagacattttcatatcctccttgaaattctattaaaaatttttagttcctatctatattcccacaacagtattgtgatgaaagacagcgaaaacttttatcacaaactgtcatgagaggtatgtctgcttacatcttccgtttttatggagattagaggtcaaatacttccttatgtttatgggaagaatggatagaagattggaagcaagatcatactcactatggttgctactacgatcataggaatacctgctctcgcataatccttgaacgtatatcctcctgccgttactaccatggtgttggccggcattccgattggtgttgcaaatgcacaggatcctccgattacacatgccatcagtacggcacttggatctgcacccatgccctgtgcgatggagactccgatcggagccatcagtgctgtcgttgctgtgtttgacataaagtttgtcatgatacagcagagcatgaagattacaaatgttaatatgtatggtgaagggttatctcccagcattccgattactttatctgcgatcagttctccggcaccggttgcttccagtgcagacgcaagggaaagcgtacctccgaataagaagatcgtcttcaagtcgatggaaaggagtgcgtctttctcactgataacgcctgtaacgatcagtgcaagtgctcccacacatcctatgacacataacttaataccaatctgatcttcaaaaatcattcccagaagtgttaataacaggatgatcagtgaaagggtctgtttccactttggaacattgctgaaatcttttgtctcatcaaagattccctcaccgcttgtgtccactttatccggcaggaatttgtatccaaacagtgcgaaaaaaatgattcctacgatcaaaatcggaagtcctactttcgcataatcgaagaatccgaattttaatccgatcttctccatagatgactgtgcgatcatgttaccaggtgcaccgatcagtgaaaggttacctcccatggctgctgcaaataccagcggcattaacagtcttgatcttgaatatcctgattttgcagcaataccgataactaccggaatcaggattgcggctgttcctgtgttggaaaggaagccgctcatcactccgacgatcaccatgatcgcaatgatcagctgcctttctgtcttggcaaagtgtgtaactactcctccgatcttgttcgccattcccgtctcaaacagtgctccaccgacaatgaacattgcaacaaataagattacattgctgtcgatgaatcccgagaatgcagtctgccagtccaatacccctgtgactaccagtcccacacagacaatcatcgatgttaccccaagcggaatcttttcaagcatgaacatgatgattgcaaatgccagaaacagtaatgtaattgttatctgactcatcttcattacctccttgtaattatttcgttcgatttactctgatacaaatttcttttcttgtctgatatttgatgtttgatatgtgattttgtatccaagacttgattataaaatactccttactgagaaaaatgtcaataggctttttgacattttggcatatgttataaaagtgtttatctacttttgttcaaaatcacaagaggatactttcattgtatactttgtacgtatttttcggtttttgacagctataatcccgtacaaaaaagaacagctccggcactttgacctgacctgttcttttccacgattccctaattttcttttttccgcttccatctctctactgcggtcagaactccggccgatataccggacattgctgcaagaactgcaatcggtgctacatctcctgtcttgaccggatagttccggtaaatggccgtttttcccgtcggagctatctccggcgcctgttcttttaccgaattcgtaaatataatctcgtacgattttccttctgttccttctttttgcccccagactactgctttcggttctccggattctgtactggtcacccgtaccgtcacatcatatactgccgtatcataagtaacatctgtcacattagcggacttctgataaatcttataatgataatcttccggttcttcatagcatatcggtccaaagctttgcttctcgtcttttccgatctgaagttctgtccggtccggcactggtatgccagctttctccggctccagcacgattgttcctgccgcaccttgtacacttaccggaatctggatctccacattcggtgttccggcatacactggaactgccattgtactgcctatccacataaataacattacgcccgcagctgctattttcttcacacttctatatcttagaatcttcactgtttttctgccacctccctctctaatttcccgatcagaactacacgaccattcgtctctgcctccgagcacgttgataaagcaatcagcgaattctcatccgccacatttacatcacgatactggactgcattcgcctgaatataatcaagcagatccttcagattctccttgcggtatccatccggatggtaaatcttcgcatccgctgcagtcactttcatacaggcaaagaaccggattttccgtgttgcatctgtcagatagagctttcctttttggtgcgtttcaaaatattctttattcgtgaaatctgccacatccgcaaacattccaccatttttcatgttgtgtccatagaccagattatatggatcggagaaatcatccttgttcaggcatgacagaaagattgctcccgacagttcgaattccccatatacattcttattaatatattccatatcatcctgcccctgcaccaccggataatcgatgttggtcttcggcacctgaatccaggctttcacatccggattcaattttttcagatctttcagcgtcgggttatcctctccatcatctgtcggccgaaacttcaacagttcttcatctgcaaatgaattggcatagatcttataagtatcccataacgaatacactccataagaaagcatcagaaggatcaggattcctgccatgatactgagtatccgattacctactcttgctgccatcgctgcctttttcatttcgccacttcctctctaatgctttcttatatcttctatctgcttttttcgcccaaccgattagtcaatatccatatcttttgcacgttttcttctgaagaacagaaggctggatgcaattgctgcaccgatcagtgcgatatatggagcaacatgaaggaagattccggttggagagtttgttgttttatcatttacaacggtaatgttcttgtcactattccctgtaattgttcctgttgttgtcagtgtttctacattatcaatagttgttttatatccatcatctgcataactagcctctgttaccgtatattcatctgtctctgacaatccaaagatctttgctgtctcattatctttcaatgtaattgtcttagcctctcccgacaccagtgtggtcggagcttttccatctgaaaatgttacataatactgctctcctgctgctccgtctacttttatagtaaatttaaagtctttattacgatttccctgattaccggtaacctctttctttacggtcagatctttcaacgtatcgtgacgactgctgtaatcattcgtgaaaactcccccatcctttgacttcgaatcagtcttatctacaaacagataagagctgacttccagatttcctacatcatcggatgttacatacacatcaaaatacttctgttctgtggtataagcaacaccttcatacgcatttccgtccttgtccgttgcaacctcacttactacatagcggaagattccgggttttgcatcctctccttttgtgaatacagattcattaacattaagctttgtcgttcctactgtaattttctcatttccaatatcgctgtccgccggtaccgatgcaatgacatccttatccaaagttaccccctttgccggtcctgcatatattgccttctgattctcacttgccggcactgccgttcctggagcaacggtaaatttaaatgtagtcttcggtgcatatatattactttccttcgtaatctgttttgtgatcatcggagttttcttaactgcagtttcgctatctgaactttctgccgctgacacctgcattccgagcattgctgtcatcattattccggcagccgtaacagtggatactttttttaacattcttttttccatcatttcttttcctttctttttccatgttctgcaatcatgttactgattttacaggttcgatctgcgaaggacggtaatcactcttccctttatatcctttgcactgaccgcaccaaagtatctgctgtcttttgcaccttcacggaaatcacacagaatgaaatactggtctttctttactttcaccggataggatatgccatccacataggccggtgtcttataaaaaatatccgactcattcacaatgcttccgttgatcttcagttcatttttgtctgtaatctctaccttatctttctctctcgccacaatacgccctgtatacaatgtcccctctttttgaaataccacgacatcccggtcggaatatttccgttccagcctgtaatataagagcagatctccggcacatattttcggggacatatcctgattcttcgcagaagtcattccaaaaatcacgccaaacaggaccgccagcatcactgccagcatgagtaaacgggtaaagaacagtatgatctctcttttttctttcatatatgctccttgtcagatgttattctcctgtcggatctccccatttgcggattccgtataccagtccgaaaaatgccagcattccgaatgctgcccctgtcatgaccatatacggagccgaagtctgccggattccggttgccggctgtacttctttcgtattcgtaaatgtcagatctgtattttctgatagaatatccgaaagttcttttttaccattgtccagtttctgttcctcttcttccgaaactttctttgtaatctgcacatcatagtcttccggttcttcggaaacgatatattctacaccatatggcatcgtcagctcgattttttccatatgcctcagctggaatgtatagactccattttctaccgcaactgcgttttttaattcttcctcactgactggattgccctgtgcgtcatatttcacatagctgattccacctgtataggatttcccgttcagctttgtctgcacctggaaccgaaaggcgtgggtacggtctcccatgttgccgccgactctctttgcaatcgtcagtacgcggtcactccggatataccggttgacgaattttgcttccgatgttgtacttcctgcaatctgcccggatatttcctttgtatccggtgataccgtcagatcatatccatcaggtacggcatcattttcatttaccttatatgttgttcccggtgttagattggtaaatgtatattcgtatgcgttgttttctgcattccataccagtccgtctgtattcaacttcagttcttttgtctctgtttttccgtctggtttcgtcaacgcacaggtaaaggacaggttctgtaataccttctgcaatgcttcctggttatcttccaatcctgtaatagctttcgaaatttttaaattgcccggatgtacttttatgactggtttcttgtaatattctgtatagttctgttctccatacttgtacatcagtactgcatgttcattttggttcgaatagaatccggtgcctcctgcataggttccggttcctgcatctgcctgatctgtgtagcctgatgttctgtatttttcatatgccgtttctgtcggctggatcttggcaatgacctcataggtatagccttcctgcagtttatagtctgccggaaattgcattttaacggattttgatgcagaatcataagaagccgtaattccaagatctgctgcattaaccaggtttccggatgtgtcaaagatctgcacctgtggtgcaaggacatttccatctgctcccttcaccatctcaacattctcactcagcggatcggaaatcgtgacatttgtacatgccagttctgtgatctgtttctgaatgtcatcgaatgccttgttcagattcgccagcgttgttccagcataagatgcatgttttccggctttgactgctgaattggcaaggtcggtaagttttttgtaattccctgacggtcctacaccgaccgtgaaaaaataatcggtctgcatatcagcgactgcatcttttcctgccttcagactctttccatcttcgtcgctgcttccattgccttctgtataaccgtccgatctatatcggaaggttggatctccatcagatacgaagatcactgctgtcttggcattctgtcttttcccattcagcaatccttccgcacttctgatcccggcctgataattggttccgccgtccgatttcggagaagtccgattcgtgatcgcagatgcctgattcgtccagtttacagcaatctctgcatcattccatgcctcatccctatatccaccaggccgatagtcactcttatttccactaaacgtcacaagcgcaaatctgacatccagattctcattagccgccagtgtattcgtcatgctgtcgattgcctgacttgccgcattccttctttccccgttattttcccagctattctgactgtcacgatccatcggataagccatacttccggatctgtccaagacatagatgacatccagcggcgctttcgaagactcgctgtttacttttccttttactgtcaatttcagatcgtaggttccatctgcattctctgtcaccgtcttttcatgctccagagacatgccagaatccgacgactcttctccctcggcatgcacctccctgatactccctcccacgggcagcagtaccaggatcgcagccgtcagtatggtaatgattttctttatgctcttccggctgatagtatgtcccataacgctcctccatttctgtttcatttgaatgtggctgtttttctttaccctcatagtattcttatgtaggaggatgggattttattccagaatttctatttaatgcattatagcgactgtcaccgatcggaataaacttacaaggtcctatcctgtgctgacttcaacatggggaaattctaaagcaaaaaagttgacctaaaaacgagctcacaaaaaatccaaactcgacattcgtctcagacagtggattttttgtgagcaagcggtcaacttttttacttaagaattaccaaccatgagtccgtatgcacaagataggaccttgtaagtttattcctgcggtttcgcatgccataataattaaatggagaactgtaatcttttattacggttcgggaatctggcttggtgaattaaatagaaattttatttataatatgtcagcatatcatcccggctgcgcataatatgatcgtacattgttttctgcgcagcctctttgtcatgcttctggattgctttcaatatctttccgtgttctttaatcgacactttcgcataatcttcctcggataccatacttcccatggacaatccattccataattcagagatcatatttttcatcttctgattaccggctgcagtccagatctcgctatggaatgcgcggttcaagtctgtgtattgtcttaaattaccttccagcagagcctctgcagcttcttcataaacagattcaatctcagatatatctgcttccgggtctgccgccagtgctgccgctgaactttccagaattgcgcggagctgatagtgttcttttatgtatgtttcggttattccaagtacgacagctcccttattcttacgaagctggatcagtccgtcacgcgctaagatctgaaaggcttcccttaccggcattgctgatacatttagttgagtagcgacgctgtccagcgaaagaacttcgccttcctgcatctgtctggacaagattgcctttctgagttccgcagctactttttctttggcagacggcattttaatcggttttaatccgttcattcattcatccctctctcttcgttaactgctttcgccagcagtttgaaatatgcatccagagctttctctgctttctttaattccccatttttcaaaagttctgtcagcttgtttctttcttcttttatctcttctttatgacgtcccgttgatagcgcaaaacggatataactgtcacttgcatttctcaaaagtcgcttaatatattcattttccaccaggtcgcacattgcttctgccggctgcacttctcccagtaatcccggtgtcgtaagcctttcgtacaattcttccgtctttttactatgcttcagactgttcagagctttctttgtcatctctgaaatcatgctgtagatcagacagatctgttcttcatccagttctgttacggtaattcttctagttgccagacggataatcaggccctgattctccagaatctgaaatgcttcccggatcgggattctggaagcttcgaatgcttccgccagttcttcctgttttaactggcttcccccgggaattcttccagataagatctcgtctgcaatctgttccgccatataatcgcttaatcttttttctgatatatctttcataatttcccctttaaattatattcttataacaataatgtatccaaaatcacacaaattgtaaagaggtttttgtctttctacaaatattttttcatatcctgaatcagtttttcacacgtcttttcaaatttttttgccagtgaaatgctttctttttctgcctccgaataacgatttaatttctctgtaatggattttattcccatattggcaccatcaatcatcatttctgctattttcgaagtgtcgtcattgaacatcatctttacttcggcactgatccatgcaaatgtctctgctgccttttctgaaaacttttcttcctgaagttttccttctgataatcttatcgattctctctccatcttttcataatcttctttatatttagagaataactcctgcaattcctggtttttcagatatgctatcagctgctcgatgctgttcactgccatcctgcagcccgaattacactctttcaggatctcatatgttgatgtgtccataatacttcctccttttttagatagtctgctatctttttatagtttttcttccttcattacatgatctttcttttatagtatttctcaaattttattttttatgtctttagactaaaaaagcccttgcagatatcatttttatatccgcaaaggcttttctttctctcatattcttaatttaccataaaataattcagactgatttcatttgacgcaacatccgcaaggttgacacaactgtttcccatacggtcgatcagatgcaggatattcgtaaatggtgctgtcaggcttgctttacattttcctttattgacacgctgtacatgcgcttttctcatcttcagatctagatccatgatcttatctttccgttttatcagcttctcgatctgcactgactcatctccctgtaatgccttaagtgaatcattgaacatcttctccagtgtcttcagactcttctgcagttcatccatcgcttccggcgtatatttgtaccgattgtctaccttttcccgtacacattttgcaacttctacgctcagcgttcccatacgttccacatcgctcaagatgtacatgagactcgccgtctgtgctgcctgctgctctgtcattgttccggccgagaatagggaggccagatattctgtgatctgatccgtcagtttcttgatctgtactcctttttcctgcaatggttccagttcattcatgtcttctgttttgacaattgtaatcgtatctgccacaaccactttcaccatttcactcacacgaaggatttcctttgcaaccagctgaagtgctgctgccggctggctgatgatcttgtcatccagaaatacaggttttgcaggattcatatcgactgcttttccatccggaatcaacgtcataacaatctttaccatcacattgatcagacagacccagataagtgtcattgtaatgttgaataatgtatgtgcatttgcaatctgtcttgagatcacttcaatctccggtcccttcggagaaatgtgctggatcagtactgcaaatggtttcacaaaccagataaataacagacatccggaaatgttgaaaatacagtgtgcaactgcggtacgtttcgcatcttttgtctgaccgatacttgccagaagtgctgtaattgtagtaccgatattatctccaagcaggatcgggattgctcctgcaagtccaagcatacttgtcacgccgtcaggtcccggctgtgatgcaaagttctgcaatactgcgatcgttgcactactactctgtaccaccagtgtcataagcgttccgacaaatacgccaagtaccggaatatgtgctactctttcgatcaggtccgtgaacaccgggctggatgccagcggtttcatgacatctcccatggtctcgattccaaggaataacagaccaaatgcaaaaattgtctgaccgatacttttcactttttcagatttcgcaataaacgaaatgataaatccaataaaaataatgatataaatgtaatcgctgatcttaaatgcgatgatctgtgccgtcatcgtcgtaccgatgttcgcaccaaagatgattgagattgcctgtggaagactcataagtcccgcactgacaaaaccgatcgccataacggttgtcgcactactgctctgtaataccgctgtagtaagtgctcctgcgataaccccaagtaccgggttcttagtcagaagtgccaggatgcttttcatcttttctcctgccgctttctgcaggcactcactcatcatattcattccataaataaagactgccaggcctcctaaaagcccgaatattatctgcaatttttcattcataatattttcccattctccttcattcgtcttctgtagaacctgccgccggcagtttctttcgaacacacgatgttccctcgacgttacgggcttattgtaacgaaggtgtatgcagcctatatcaaatctatgttaaatctatgttaaattgtacccggagtttatattacattaaattctatgaaattattttcgaaaaaatgtaaaggaatcatcaaatgtatgcaaaattatctgaacacataagatgattcctttttattgtttattcctattgtttctaatataatggttcattctcaatcagatattgaaagaatgcctcgcagccttctttcacatcttcataagtcacatcaaaattccccgtgtaccacggatctgcaatatctcttgcatctcctgcatattccagtaacagatgtactttttgctccggatctttccggatgatgcggttgatgttgcgaatgttccactgttccatgccgatcaggtaatcgaactcttcataatcttttcgcgtcatctgacgtgctctgtgattcccacacgggattccttcttctcttaatttgttctgtgtcccatagtgtaccggattgccatcttcttcgttactggttccggcagagtcgatgtagaaagatgactccagattcgctttttttactaaatctttcattacatattctgccatggtggagcgacagatgttgccgtggcagataaagagcacttttatcattgttgcataacctcgcatttcttagtttttcttggtatttcgggctttgtgagcctttgtaaatttttgctttctggcataactttgtttatatttgcataatgtcgtccgcaaaaggtgtaaaataaggtgtatatttttctattttataccttgctgttttcaattaaaaatcctaattacacaatccgaagtctggcgatttcttctctggcatcctcaagatttacatgcgtatatgtattcagcgttacgctgatgtctgagtggcccatcaaatattgcaatgcttttggattcattccggattttgccatatttgagcaataggtgtgccgacatacatgcggtgtaatgacaggcatctgtactttgtaagtattattatatttctgaatgatgtgttgaaagtaattgttaaaaatggaaattgtcttccatcctctgaaaaataagcggataaaagaaaagcgacactgcaaaaccacatgctaagggagttctgcagtatcgtctttttttattcttctaccttccactctctggtatcaaagatgtgaagatgcagtgcttctgaaatatatcccaacaattcgcagcctgcgatacagtttccttttttatcaagagacggtccgtagatcccgattcccattttctttttcgatacgctaagcaggccgccgccgactccgctcttagtcggaattcctgttcttaacgcaaattcacctgatccgtcatacatcccgcaggtgagcataatggtctgtaccatccgtacagtctgagatgagatcagacgttttccggtagataattgcactccgtcatttgcaagcaaaagaccgaacattgccagatctcttgcatttaccgacatggaacacatctttgtataaaaggtaacactatcttctacatcggtatcaatgatctccttactttttaaaagataggcaatcgccttatttcttgcgcaagtcgccatctcagactgaaatacagcttcgtctactgcaatctccggatcttcacatacgtcctgcatatacttctgcatatcttcgatggaatagtggtttacaagcaggctcgcaaccgtgattgctccagaattgatcatcggattaaagggccggttacttcggttatccagttctaccagtgagttaaaagcctcccctgacggctccacaccaacatgattaaacacaaactctgctccaaatgtttccagtgccagacacagtgccattactttggaaatggactgtatcgtaaatctgtcttctgtatttccggtctcaaattgattgccgtctattgtgtaaaggcagattcccagtttattcttatctgccttggcaagctccggaatatacgatgcaacacttccataccggatcacaccttttccgatacggatggcattttccagtattctcataacctcttctgatttcatcatattctccttttttgctcagtcataatccccttacaactgctatttcctaagtactaaaatacatcattttccggcttcaatcaaccaccattttttgctgaaacccgacggaataagatagacaaaaaaaatgcccgcattgtatgttattagtagtttgaaactggggaatatgcaaaggggaaaacgtatcatgaatctaatttcacaatacaaaggtcttagaaaagaaaactatgtcttatgcttcgaacgctttgtgacggccatgggggcaatggtccgtccgatgctgacgatgatctgttctcaatcacttaatgatatattttgttcctctgccttttccttcaactgcaatcacaccctttttctccatagctttcagtaattgtgttgtttttgatttgccaaatgggacatatggtgcaatttcacttattggtttcagcatcgtcttacttaaaaatttgtaaatcactttttcgtcttcggttaaattgacattcgtttcaaatatcggtagtacaatttttatagcattttctgacacttcaaattctggttttatcaaattctctgcatacagttgtttgattcgtgtaattcctgttccaaatatctctactaatcccagtctgtaaaatacatttgcaagatttctatttcttaaaatagatagtttacctgataaatattcttctgccgttattccagccggcaatccaccaggagacactacttctattctatcatcaaacatagaaactctgatgtgtgaattaatatcccataccctatgaatcaaagcatttgcaattgcttctctgaaagctgcttccggtattttctctaccatctttctgtcagccccctgtattacttcatattggtaataatctctaaatacagcaagtgctttttcatatatttctaaaaccgatatatgttcaaacgttactcttttttgaataatactgatattctcaccgaacttaacaatatcaattcctgaaaaatgatttttatctgccaaaagtcccgctgcattattataaccatttatattgtcatacaggttcaatgtctttaaagtatcttgattgaaagtttcaatgtaaatattttctttcagtttacactgtaaaattttaaaagatagctcctgatctttacaaggtaattcttcgaagctaatattttttccatctaatacaagccttgaaaattccaatgtatctacctctatcgttgctgtatcatttcgtttgtatgcttttgatttatataaatacggtttttgaagaccactttttacagtaagttttatcgtctggtcattattctgtatttcaagtgtatagtttggttgaggtgatatactgtcattgattttattttcgatatccagacaggcctgttttacatctggcaatcctttcacatttccattatcatcaaccccaaaaagaattgttccaccattgtaattcgaaaaggcactaactgttttcaaaaaagtattcgtaatcatttccttgaattctaatattcttgtttcacgcatagtaatcgttccctttccaaccataatgattatattatatgcaaaaatgcgcaaaaaatcaatcgtatttttttacgattgattttttaattaattttgagtgtagtattatttttgaccaactaaattatgacaactttttcaattattccgattcggtcttccaaaggtataaataaggtgtaaattatttgtttctatctagaaaatcctataaaatcaagtctttctcgccatacttaaaatgttgccgtggcagataaataatattttaatcatgccttaaaaactccttgaaaatgctgatcttccttgatttcacgccactttctacgatttgctttgatagattgttttcttcgttttcgtcgcatatcatggcataaattcgtatatcttgtcatccaaatttagtaaaaatcttagtaaaacagcttaattttctcattttactaaagactttttccacttaggttatcttttagttgtatcaattttcttaatcttttaagccatcttagcatatttgccaagttcttccttggcatcctctgctcccagatgcgtatatgtattcaatgttaccccaatgtctgaatgtcccataagatactgaagcgttttaggattcatcccgctttttgccatattgctgcagtaggtatgcctgcaaacatgtggatgtgtcaagtataggacaaaaaaaattttatttttttctgccgaagactatctgacgcttccatcaggtagtcccagcacctttattatcttctgataagtccttcttgtcctgctcaagttacctctgttccgaaaaaatatcgtcaaaattccattcgatttcaatttcatcctgactatgaacacggatcaccttgataatctcacgcaacttctctgtatcgaacttctgaattcccaagaaatcttttagttttattttatcagaaagttcattttgttcaagaagctttttactattctccgcatcttctatctttcgttttatttcctccagctgtacacttatctttccagctctctgcttatacgaatcacgatctatacgaccatctttgtaagcatcatagagtttcatcttttccgaggtcaactgtcggctttgtttttgcaattctgcggtattgatctctttgtcgtcgcattgcctgttggaagatactttcttttctttttccaacattgacgctgcatactgatggacaagcccaaggatattctcctccagcggttcccgtcggatcaccagacttcgacacacaggatctccattggttcgagcatctgagcattttagcagatgctccgtttcttttagtaaagaatgcccacagttggcacatatcagtaatgccggctgttttttacgcctttccagagtaaaattggtgcgtgattccgcaacacttctcttctttttcggatgcatttcatttgctttttcaaacaatgccctgtctataattgccgtatgatgattttccaggcgaatccattctgtttcatcattcagaactgctttatgaccggtatgcatactgcaacgtgtttttccccagattctggttccaatataaatctcatcccggacaattgccgctactgtcgtagggctccaatgtttctttttgatcgtgtcaaacctctggaactgcacctgatcccctcttgataatttctgctcatcacaagtggcaatcgcctgtctgttcaattcccttgtaatatctgcaaaacttgttccttccgctgccatccgaaaaatcattttcacgacttttgcagcctccggatcaacttccagtcttccgtcttttccttttttatagccatatctggcatttactggaaggcgtgtaccatttctcgttcttgtctgtaatgctgatgaaattttcttggacaaatccaggctatacatattgtataccagattctgcaatgctacattcattccaccagtcattccgctgcttgctgcactgtcatagctgtcattaatcgaaataaatcgaatctgtagaagtgggaaaatatattcaatataaaatccaacttccagatagtctcttccgaatctggaaaaatcttttacaactacacagccgatttctccacttttcatgtcatcctgcagctgttgaaatccctgccttttaaaatgagtaccgctgacaccgtcatccacatattccaggatatctgcctcagcaacacccaactgatcaatcacaaatgattttaacagaattctctgagaagttacactgtcgctctcttttttggctctgccatctacattgtcatcttctgcggataaacggatgtaaacagctgtttttctatgatctgtcatcttgactgcgcctccttctctttctttaatttctgtaaatctgcaaactgatcgtcatataccagcttgatctcataatcatacttaccatggataataattgaatccacaaaggcatctgccatttcttttgtcagcttacgctttgacatataagtatgtatcacatttccccagccttcttcaatgtggtaatcctgggaataccgaacctttgccgccaatactgtgtccagacggctcttgatattctcaatttcattggaatagatccgagaaaactgtatgtactcttcttctgtaatcaaacgttccgagtaatcttcatataaatccgacttacgcttactgattcggcttagttcccgtcggagtttccccacctctttatccaaaagcaggtactgtgtctgatttttggaagctgcattcatttcctgaatcattttttctgtatccaatacggttttcatatgcgtttggatcaggcgaagaacatcgtcatccacatattcttttctgactctgtgccctttgcattgctttcctccggatttatggttagtattggctccgcagatataaaagaatgtgccatttctttctctggacaacgtcatgcggttgccacagcctccgcaccatatttttcctgtatagaaattatgatttcgaatagccccattgttctgctgatgtttcttcttataagcttccgtatattcctgaattttagattgtacctgttgaaacaactctctatctataatcccttcatgcgtgttctccacatgcacccattcactctctggtcgatttctctgtttattttcctggaaaacactttgctgatattttccaaatacagaatcacctgtgcaatgaacatcctgaagtactcgcttcacttcataattattccagggtttagactccggaagcggcttttcaccggttttatagaattttctctgtaaagtcggcgataaaactccatctttattgagctgtcttgcaatatcactataattcctgccatccatatacatagaaaatatacttttcagatgttctgcagcttcatcatcaacaatcagctgatgatggtcttcttctgactttctgtaaccatacggttcccaggcacttgtaaattttccctctttccaaagtgctttttttgcgctgctactcttcttggcaaggtctttcgaatagaattcattgatgatattcttcagtggaactgtaagatccacaccttctctgaaagaatcgaaatcatctgtcacagccaggaatcttacatggaaaaacgggaatactcgttcaatataattgctggtttcgacataatttctgccaagtctggacaaatcttttacaataacacaattgatttttccatgcttgatatcttccatcatctgtacgaatccaggacggtcaaaatttgtacctgaatagtctgagtccttataaactttcgcaaccgaaatatcttccgtatctgctacaaagtttttcatcaattccacctgggtttctatcgttcctctttctagtgtttcttctgtttccattgaaattctggcatacaatcctgcccggaatggtctgctcatctctgtctggacggttgcactgctgactacttccggaatgtttttcctgctctttcgtgccattttatacaacctcctttaccttgacctgcagattattatcatcatctattaccgtatcaactcccatagccggtaattgactcagcaatgtctgataacaatcatcaaaatcaaaagtgatctctatattctttttatcatatactcggatttgcctgatcagttctaccaccacagtgcgggacagttcttcaatatcttgatatttcacaaaataatccagccaggtattggcattgtctgctttttccagctcactatccatttctttctggatcgcacggatactctcttccgcatttttaagcctctttccataggctgcatgaagctctacatagtcttcttttgatacaatgccctctttcatatccgaatagagcatcatccgtaactccttacagcgttctgtctcctgttttttcttctccagcctgtcctgcagcttcttcatattgatctcctgaaatggcacagtaccaacaaattccaggactcttttcaggtgcaggatattctggatatgctgtttcagcatcaccagtacggcatcttccagatccttttccggtattctatgactggaacagcgttttgtttctttatttgtggaacatagataataagcatattttttccctgccacagtggaaacctttcttgtcataggtgcaccacaatccgcacatacagcaattccggataacagatatacctgcttttggtcaggtgaagtacgtgtatccatgcccagaagtctctgaacaatttcaaaatcacggtcactcaccagtggctcatgatttttctcaatccggatccagtcatcttccggtttcacataagtctgcttcactttatggttcggtgttgtcctttttccctgcacaaggtttccgatataaacctcgttttccagtattctgcggactgtaacagaactccaaagtgcctgttctttctgtcggaagccagtttcataatgactgccactgctgattttatactcaaatggggaaagaatacccagttcatttaaacgattagcgatcgcatcctgactcattccctgcagcttcatcttaaaaatatcctgtactacactgcctgcagatggatcaatctctaatttatgcttatctgtctttgtcttcctgtatccaaaagctacaaacggagtcacgcattcgccttttttcctcttaatctcaagattactcctgatcttaatagaaatgtcacggcaataagcatcattgattaaattcttaaatgggataatgatttcgtctgcctgattctttcccttgagactgtcataattgtcattgatggcaatgaagcgcacaccaagagccgggaataatctctcgatatacttcccggaatcaatatattcccttccaaatcgtgataagtcttttaccactatgcagtctacaatcccacgccggatatcttccagcattgcctggaatgctgggcgctcaaaattagagcctgagtatccatcatcaactcggactgaaacaacttcaatatcttttttgtctttcaggaaatccagaatcaaagctttctggttagaaatgctattactttccagttttgctgaactggaaatatcgccatcttctttagataatctgacatagatggcggcatgatagattttattgatattctgatacatatcttacctccttttattacgtcagaaaatccatgtaataaaagggggctgcataatttgtccttaccgacattctaacacagtcccctcaatcttgccagtactttttcagacactcagaagcatattctcaaatgcctgctccatagatataccgttattagcaaatctgacttttactttcatattaccgatccggaccaaatatggatttcctactttattcagaaaaatatctctccgttcctgaagcgatttatttctgtctgcttttatcatccgtaggtcagtcatttcattgatatctacatcactgaaatcctgctccagatagtttctatattcctctgccgtcatgcccttctccttccattcccatctgaatccgtactgctttcagtacccgatccaggctccacttatttactcttccgcatttctcaataatacattttgtagaaatgctcataacctgttcggccaaggctaggcttccttttcggatccctgtcatgtcatatttactgataaatacatgtgttggcaaataccgcttcttatatattcttgacgtcagcggaactactgtaatgactgaactgtatgtattagctttgttgttacttactacgatcaccggtcttactccaccctgaaccgaagttgtcgggaacataccgagatccgcccataagatatctcctcttcgaatcgtcacttgtcatctctccaatccttttttatttgtaaagcattcatagcgctatattagctccacaggaatacggcagagttcctttccaagacggaaagctctgccgcataacctctatagccaatttgattattaaacagtgctcgctcgattctatttatcctcgataccccgaatcgttactcccgcatatgcaggaagggaataataacctgcccggatgcatactccggaccacaacccggaaactctcgtttccaggctccagcagttcataggtttaccagttacagacttctcaggatctgcaagtgtatcgcatctcatacatatcatcgcatcaccagcctgccagctggcttcggtcagtgctttttcgcagcattacggactgaactaaaaatctttgttttgtcttataatcctatagcggcatcttcctcgtgctctttgcatgaaatgtcacgtcagttattattggatattcagttatcatggttcattttaggaagtcctttaacttcctctaattactaaagtcaaatgactttggcagatgcaaaagattttgaaaaattttttaaaaaaatttattcatatacatttcacgcatcttattaagagtggattttaacttgtatgacagcatctgtctggaaatccccataatctccgccatctgtgtctgtgtcttgttttcaaagaaaataccataaataatcatgcgttcctctaagttcagttgattgatcactgtgtgaatatcctgctgttccatttttgtcagtacacagtgctccacatcacagttcagatctggaaaatcctcaatcatgaagccttctccatcaatggactgaccgctgtaaggtacttctctcagcatcttatccacaacctcacccagttcattcttaatctcaactttttttgccttgctgcttctgtaaaaattattcatcgcatacgcaacttcttttgtaatctcgatcatttctccatcaatatttgcgtaatactttccttcgtaaaaatatgggtgttcaatatacatatccgttcctcctgaatttgaaatcttgttgctcgtttcaaattcggaaggaggacctttgtttaggatcatgcctgctccgccttcatcctgccgggacacatccgcagttattggctgataaattcaggcacgaaaaaaagccccagtagtttttcttaactactgaggcttctgtctctttcttgtattcagttatctatgccctctttcatcagcataatcattgtatcaggataaagttcacaaagtatccgcaatacgttcccataagttcatgtcataacagaaatcgtacatatttcggtgttaaaagttcaccctgctattcttttacttcttttccatctatatagagttcaaatatatcaggattattgacaacatcataatcctttccatattctacaggtctgtattcgactgtcatcaccgacgctccgtcttcaatatcctctttccatagatatatattcataccaaggctcgtcgcatatcctctgtccgtagaaaactttatcgaataaaagaacttttctttaatactaatcctatccgataccagtcttttccctttcttgcaagcagtaatcccagcccaaacttctggtacataatctgcacaatcagagatacttcataaattcgttactatttttcaattataatactctgataaaaatatcgaggacctcattttcagaggccctcttaatacaaactttccatgaacatctcgagcttaaatccagaagcagttatcctgatatgtacattaacagatcctgtgtataatattgttaacttcctgatgaattaactctcgactgtacgagaaccttataataatggatttgtgactgttttataagttaactctcgagagttaattaattctcgtgtcgttaacgatataacacgcacaaaccgcataaataagccatttatttggaacgagagttaattttacaggaagttaagaaatatactataaatgagcaaatttgaaaaattgcacaaaattatcctgctaacttcataaatgccttaaaatcattacttccttttgcaagttggaagagatactgatacttttctgtctgaataatgcttccaatccggtggtagcctttttcaaaagaacagaattcaccagtccctgtcacacacataaaatgtgccattgacataagaagccagtatcttcggactccctgtgcagaacgtatctgatagctgtccagtgccagtttattcttacactggcgaaaaaatacctctatcggtcaccggcagacataataagacagtgtttcgtccaatgataatgaaacgtctgtactgagaaaagcacgcagtgcttttggatttccaaatgctttttccggataacttaaaagaactacggcattttcaataccgttgagttttccctcataacgatacacgtaatatttttgttttttcactgtcacaaggcgaaaattggaacgtgtggacgttaaaaaagcagcaaactcattaagtttctttttgaatccaaatggataaagcatccggtttgttttcagtgcacctatggtatgaaatcctccggctgcgaaagtgttgattattttttcagaagtataccagcaggaaagcataacagcaactgcctggtgtccgtaatcctgtttcccctttaaatgggattggtgaaagtacgcgtcttcaattggatgcagagcctgtgacgaaggctttgtttttgaagctgtcgtatcatctacaatacagaaaaaaggctttccggtgcgagctgcttctgaataaataatctctataacagaacgttttaacgtatctgaaagtgaggaatcatcccattttcctgaattaaggaaatgtgcgatcgtagtcctgtgacaggaactgtttttagcaaagtccgtggttttcccatggtatcctaaaagaaatatgctgatcagaatgctcataagatgatttatcactcgattggaataaaatttgtataagtttaatttcttaagctggttgtatatgaatgtagaatgatgtatagtatttgcgagagacaccttctttcgtaaatgttgcaaatgtttgtttaggtactttcattatacaacacacggaatcaaggtgtctctcttttatgcaaaatcacgaacttgctcatttatagttaattatctgcctacaattctatcaaaaaaagtaaaaaatacttaaattcggaacagattacattaatggctcaatatatcctagctttattgctttgttataagcttcaactgtattagatacttcaagtttatcataaatattttgaatatggttatataatgtacgttcacttataaaaagattctttgctattttcttctttatatcccccttacaaattgctcgtaatatttcaatttccctctctgttaatacctcaatatctggaattttattataatatgttttattacaaagaactctctttaatctttctactaattcctccatagaaacagacttatttataaaatccgcagctcctttgtcaaatgccatctttttgtatataggcatatcatacgaagaaagtataactacttttgaatctggattaattgataatatatctgccaatatttcaaatccattcttttcagaactattctttaaatttatgtccaatagaataatatcaaattctttttctcgaaacgtacggaaaaaatcattctccctttcaacatagtagcaaagtgatacaaattgactctctatcagtaatttctttaaactctctccaaataatctatgatcatcaaatagtaaaattttcactaatctacctccagctcgacactagaccataaaatgccatttgaataattatatgtcaatttcccattgtttgcctctacaagcaccctcaaaagtagcacaccacctttagacttgaaaatattttcataatctattgcactcgccccatcactcttgcagttaattattaacaccatattttcgtccaattttatttcgtatttgatataagtcgcattggaatgcttaaaaatattgttaatcaattccttactaatctgtaacagcatttctaaatgcactttattttttagatatttttctgctttttcatttatatcaatttttaattgaactttcttatttggatatatggcttgtatagaatttaacatattttctaaattaatataggcaccatattccagaaaaatatttgccgaataaaaattcatcattttccttgcacgatcttccagatttaataaaacctttttcgatagcacaatatccggttgttctaatgctaataaattgtaagatgctctgatatcctggacaatatcatcgtgaagtattcttgaaaaattctctctttcagtatttatatactttgttaagaaaaaaaaggaacttatttctctataaaattcttgcctatcctctatatgtatcatagttaatatttcaaacaatagcataaaaacctggaaaatcatattaaggcaaaatgaatcccaatcaaaaatataagatatatatactactagtggtatccataaggttaaaatatattttgacttctttgcagaagtcggaagtatatgtacatatttgaaatttatccatttatacttaacaaaaatatctaccgccatgcccaatactatcataaacgaagaaaaaaggacaaaccgattaatgtaaaaaagcaatcccaaaaaataagaaataagaacagttatttcttccttatatcttttcctggctaataaattccttgccttatacaataaaaataatacaaatgcgatttcaaaaattataatacctgttctatgtatcatggaactacagaataatataggaactgtataatcaatactatccactatatctgtttttttttgtgatgtcataatatatacatataatgcactaataaaacaaactaacaatatcatagataatgcatttatctctacagcatcatttgtaatcaaattaaatttataaaaaaaactccacataacaattatagctatatggagcagaatatatatgctgtacttactcttcatactctttttcacccacatcactgaaacatcatttaccgtatctagtagtatgccattacaattctctctttagtggccattcgcagaacaaatacactaacacacaaacttattacatactttattataacagttaaaataaaattattgctccaggaataaaacatactctcaataattaaaataaaaaaataaaatactgatatacgcaaagaaattcccttatatttattcatatctcttataaccaaaataactgcattaataattatactgcttaataaggtaaatgtaaagaaatcaagtatttgggcaacatcaggtgatcctattttgtatatagtaatacctaacagtggcataagaagtaagagagttgatatccacaaagaaactgtatgattaataaggatagattgaagcctagtcccatttgcaatcaaccactctattcttcttgtgattttttccatttgtagtaaatctttacttaattcacaggcaaatataatatataaaaaaatataccccttccaaagcatatcaatataagtatatgagccaattattttttcctgccctttactaaataaggttaatataccaaaaataattgctactagactcataaaaacaaaattacctgttaaaatttttttcacatgaatcctaataatagtcaaatccattgtccaacactccttacaacactttcattgtctaatttagaaatctttctgaaagaaataacagctaaaattgtcgcaccaattatattcagaataataataaaaatatacatactaatatttaaacctgatacaaattcaacaatttcattcgcacacatagcactaatataaatcagaaaaaaatttccaaaaaagaccatatttttaaataacttatatttttctacagaaaatgtaattgtattgaaaaatagaacttcagtgtaactcattattactgtcgatataaaaaaggctataataccaaaaaatgaaattttaaaatctatgagataataacctaatacaaatataataaaaggaattataattgatgcttttaaaatttgtattgtgtaggccttaataataaactttaaatcaatccctgatgctaaaaaaaactccatccgtttactcattttatctttcactgtcaaatctattattatagaatttgcctgaagaagagtacatcctaaaagaactacaaaaaaaactaaaataagataatctgttccttttgaataaaattgatcctgttgaaatacaaccaacatcagtgtcccaagcactcctactcctaacatattaaaaattgtagatttactcttaaatataatataaaaaacagcttttttaatattattcataatctccaccttcttttataaataactcttccagtgttgtcccttttatgttatctatatcctcattgaaaacaaccttaccattttcaatcatagtgacataatctgcacttttctcaatttcacttaaatcatgagatgtaatcaatattgtttttccttcttcctttagtttctggataatctttcttatttcaacacgagacaacggatctacccctgatgttggctcatcaaggtaaataatctcactgttgattagtataacgattagaattgacaattttcttttcattccttttgaatacgtactaacacgtttcaataaatgttctgtaatatttaatgaatcactatatttcttatagtcctttacgtagtatccaaaatacaacccaaagattttcaagttctccaaacctgttttatcctcatataaataatcattctcaagcaacattgcatgtttacccgatacagatatttttccttcatctggttcgtataatccggtgagtaaacgcaatagtgtagtttttcctgctccatttgctcctatcaaggcatggacagaatttttcttgacagtaaaattaaaattttgaaataatttcttaccatcaaacgcttttgaaagattgtaaatagaaataatatttgtcattatattaacagcctcctaaactcatttggtatatattgggaataccatgcacaattttcaaagcctttttctttagcagctactaacccacgtattatgcaataactacaaaagtactttttttcacaccctgagcattctttacttgtataatctggagcttgtataccacgaatcatattcattaattgataattatttgaaaacaactgtccgatatcctctttaaatacatttcccaaagatttaatcactgtctggttatccattgcacaaaatttgatttctccctctggcgttattgaaggattcgatgtaaatgctccacaattctttgcgttgctatttccgtctttaattttatataaaaacccttttccatatcgggtattaatgttttctattactttaccaaccctttcatgttgttctaatgtctttaaaagcaaattatttttatcctctaaatcagctcttcccataggagtaattgctgatataccataagtttcgatacctgcttcttttacccatcctgcaatattttcaatttggtcaatgttttgcggtgttaccattgtaacaactctcatcagtattcctgaattattaattctcataattgtgtctttaacacggtgagtaatattgggtatttgtgttcccataaaccaatttatataatcatcattatctccgtgtaaatcgatttgtacaactgtctgctccttatgttctgcaatcagtgcgaacaattctttattccaaaataaaccattcgatagtatacttactaatgaatagtcaagattatacgcttcattcaggatttctaaaaacctcggatgacacgtgacttctccacctgtaaattctactactcttgtccctgctttacgtgcatccttaagtaacttctttatttcctctgtattatctttaaatgcattcgttgcacaatattctccataacagtgcaaacactttgcattacacctatgtgtaatttctacagaaatagctgatggatactgtgtttttccatttccaagtattggtatttctattggatttgttttttttaaatactccacagaaattcctggatttttctccaattcattcaaaaaattatttaatttatacttagcctgttctttcttctctaaatgacaactgatcatcatgtcaactagatcatcaaatgtttttgtcccatttaggttacgtataatttctaaagcatctttgttaatgcgatacaatgattcacccatcttttcataacggttatttattacaagaatataagaatctctttgtctttctattgcttttacgttaattaatctcagatacataccttctccttattgttgtttaacctacaatataatcaatcttatttctattatcatctgtaattattttatagaaagaacaggaagtgagaattattactatctagcggtaaaatctcacttccagtcttctgcttgttatgatttattactcagaaaaatccaacaaagcctgctgcacccgctgcagcaattgcggatggtccacagaacatacaccctgtacatcctgcacataatttacatccgtttcccattggtgaaatactaggattcatggcatttcctccttatgtatattctcgactttgttatcgagtgactaaattatatattagctttacgacatttacatgagtaattactgcaatgttcttagattatgtcgattatgccattaagcttaatcattaaaagctttatttactactataaatataatattcctatttccatttattcccctctaaattcaagatcatatctttggaatgcgatttcgaaatctttacgtcttcttcttgcaacatttatttcttatccatttatatttattgttccttttttataagaatcaacattcattaaatttacaatgccgctcttactaattcttataaataaatttctatccaacatgtcttccagttgcacgagtgaacaatctcttcgcattgttttgcttcctaatttctattcacatcaattctgagaaagcactttttctttgtgttccaatttcttaaaaagaagctgccagaaaatcatatcttctggcagcttctttgaaattcagtatttgttaatgtgcaacactcatgctctcatcaatccatttctgtacgacatcgacgccaatcttaacggctttagcaatcttgtcagcaggtaaacccatctctgcaagggcaatcgttgtctcttttgctttttgcatttcaccgctttcaataccttcactgtaaatctgttccatctcacggcacatgaattccacccctttctgtgtttccttcaattcgtatactctgtcagcaagtatcttactgtgcatatcttctgcattcttacagtgaagatcatgcatcagtctgcctaattctgtatcctcttgtttcttagaatttacatagataatatgagcttcatccttaaaattctcactgacttcttcgattttcctgtctatatgataaatcggaagtccgtatccaagtgcatcgtctctggtgataaaaatcacgtagctttccggaagttcatcaaaatcctgtcctggatttaatgtgttcatatccatcagaccactatgataccttgctcttttgggagatgccccttcgttgtcctgttggatttctacatccatctgcttgccttcagaatctctggcaacacagtccagaatagctgaacgcccctgcaaattcttatagtctttctgcagaacttgatcaatcactttcagatcctttttattcataattacctgcagaacatattctgtacattcccgtttcttgaatacattccgcataaacacatcgctcatgatggtaaggtcttttaagatacccttgtatctttcgtaacgtgtttccaattcttctgttttcacgatttcttctttcgccacgtccattctcgcctccattctttgctatgtcaggataggttcctaaatgtctcctatcccaatttcatcttaacatcaaaatcagcttttcacaagccactattttatcctacaccacttgaaaacaataatttccaatcagtttcatccaactattatatttattcttttcacacacctttcggcaaatttcattttccatcaatacacagaacatcttatcataatcaaatgcccagacagcaccattcacatggttttccactgctttctgatctatgtgctttaagcgtgtgaccattttttcaatttctccatttcccaagttaccgatatttttacagataaaccgaaagaaattcaacgttgcatattcgtcatgccaatggaattcttctggattgtttttaattttactggctcgctgctgttctttgattatctgatcagctacacccttcatcgaatcttcgtatctcatattattcacctactcttcctcaacgcccagtgatggtttaaatcttttatcttttgcctgcggtaccactatctcataaaaataaaatcctaaatatccaagtgcctgcttcttcattttataaaaagaagtcctgcctacgcctaactcctgctgtacttccacatctgtcttattataatgactgcaaaagcaggaatgaagaatctcactgagcatcacaccattcggtgcatagaactttaccagtgtcattccacgatagatcatatctgacaagccgtaaataatcatcaggttattcatttcccggtgcatctttggcacattcagctgattgttataaatgctcagataactcaacgcatatgccatatcttcattgattttctcctggcactccatatccaattcttctaacacaatctgattttccaaaatcaatttctgatagcttgtcatcagttccttgatatctgtataatgtctctccatcgttacttccagataatcctgtgcatggcttgccatctggaaggtaatctctttcattgatttaattgcataatctctgtctgtcatcagtttcaaaatctccttatcatcatcacactaactggcggtctttcagaccagttcgctttccccatgattttgatgggaagcaattacttactacaacttgcagaagcggatatccaaaaggcattgtgggagctgcctttgctgaccggaatccatcttcttatgtaaaacctacaggaatataaagggaaagtgactatccctgccggttaataatccaaataatatcgtctataccaatctctccttatgctgtttttctctccataaaccatttatccacttcataaaacaaatggctttcctgtccctgtatcatacaggtatacatcattcctacaccgcctgcctttctgctggcacatcgctcaattttcaaaattctgtcaatgttatatttttttccatcttcccaggtgaaaaatataggaaccagttttccgtctttccgaaactctgccactacatctacatacactttattcataccgacacctcactataagatctctattgctcttggcgatgccggaatccttcggatatatccgttttgttccaactgcttaattctggaaaaagcagatgacgttgatcttactccgatcagttttccaaattcccgaactgtcggcggatatccatgctccttcgtataattcaaaatgcactgatagctttcttcctgttttctggttaatgtctgtttcaaatctatccctcccattatccatgaaaataactgtgtggatgaactgtatgtgtaccagcgtccaagtgggataagactttatcctgatacataactgctctctgtatactgaaataaccaaaccgtcgtctgatctcatctacagtgcgatccatcttttccaatttttcctgtttctcttgattaccaaaaagttccaactggacgggaatatcatccaacacaagatctactgctcgaataccaaggcttctgattggatgctcccatttataataatccttaaacaattgaaatgctgctgtaacaatctcatctgttatatttgttggatgatgtaattgtttctgcctcgaaaaacgaaacaagccattgtctcggaccgtaatttctatcgttttgcatttaaaaccatgttttcttaatcttgctgcaacgctttctgccagtgccatctgaatgatccagacatccagatcatcttctaaatctcttggagttgtggtactattaccaattgacttcaccggagctgtatacccatctttgcaaactggatcatcgtcccagccatttgcaaatgaccataacacaattcccatctttccaaaatggctttctaacattgcttcatcactttctgcaagttccccaatggttcgaatccccagcttctgaagtttcttccgagtctgtcttccaacataaagcagatccgatgcaggaagctgccaaatcatacttttataattctcccggttaaactctgtaatcgcatctggctttttgtaatctgaaccaagtttcgcataaatcttattccaggaaattccaatacttaccgttacacccagttcgtatttaatccgatggctgatttctcttgcaatcgttattccgcttcctttcagatttctactggctgatacatccagccaggcttcatcaatcccatatggctcgatcttgtccgtatactccgaatagatttctcttgccatctgtgaaaatctcaaatacaagtccatccgtggtggcacaaaaatgatttccggacaaatctgttttgcctgccataatgccattccggtctttacaccttttcgctttgcaatataatttgctgtcagcacaattccatgtctggcttccggatcaccgccaactgcaagaggcattccggcaaattccgggtgatgcagcatttccacacttgcataaaatgaattcatgtcgctatgaagaattgtcctgtctcccattaactccaccaccttctctctgtttggtttattgtcttatcaatttctgtatgcttagtatatatctccgtattggagatagtcaagcgacatcttggtcgtattatctccttttcggagatttttcttgatttttgattttattcgggttataatgcatatagaaaaatcaaaaagaaatgaggcgaacatatgcgtgctttcggagaagtattagtagaaaacagaaaaaggaaaggctactcccaggcggatctggtggacttacttgctcaggaaggaattgaagttactacgaaagcagtctccaaatgggagaatctaacaagagaaccctccttacacacaatcctgacagtttgtcagattttagatattgaagatatatacgaagaatttttaggtgaaaatccatttgatcatgtcatggaaaatttgaatgaagacggcaaagctaagattattgaatttgccaatcttctgcgggcgtccagaaagtatcttccgcatagagccgatatcattccatttgaaaattatcagccgattgcagtagagccagcttctgccggtactggaaattatattgaagacagtgtaaaagaaagttacaatgtcggtcatctcgcacctgaaaagacggattttggaatccgtatatctggtgacagtatggaaccaatgtatcataccggagatgttgcatgggttcataaacaagacagtatctccaacggtgaaatcggtatcttctatctcaatggcaatacctatatcaaagagctacatgacggtccggatggagtttatctggtttcattgaatgaaaagtatcatccaatccagatttatgaatctgattcttttaaaatctttgggaaagtaatcggaaaatgcaaaggagcagaaatccctggttttcattaaagatcaactgcagacttctagcctgctcttgctgaaaataataaaggaagtgataaaatggcaattaacaacacacttaaagatatccgtgaagaacgaaatctcgttcaggcagatcttgcaaaagctgtcggttcttgcagtgataccatcggacgcattgagcgtggtgagcgaaatgcctctctcgaaattgcaatccgtctggcacattatctgaaaatgccagtagaagagatttttcaaattgaagactgaaccgcaaatatcagaaaaccgaggactgttccccggtttttctttttcgctaaactatttagagtccttttacaaactcaactgcattttttatatcttttccatctggatgtccttttgctataccacccaccagtttaaatgggccaaatgtgtcatagcccttgcatccgaattttccgattgctgtagaatgcttcttgcccaaaatctgctctatggatttataattcgcacttccaccataagtacagatcagaaatacccctttgtcgtccggtagattcttctctgcaaatcccaatatcgactgatgaaattttgaaaaatagattcctgatgcaaacccaatcgtatcataactgctcagatctgcatctggctgttttacagcatcaatcaaatcaacctgacactcttctgcaatgctctttactaatttctctgtgtttccatgatgcacagatgaatatacgattacctttctcatcattcttcctttcctctattcccatcaatcatatcatagctcatatccaaaaaatctaatgtctttgcttcacttactgaaccatccagtaaaattgtgatccagtgctgtttgttcatatggtatcctggcaaaaatccaaaggtctgaataatcatacttgtcatttccggatcacattttacatccataatatcgacaaattcatttccttctaatcctagtttgcatttttcaacgctcatgaccacagcataccattttccattcttatgtcgcaacacagcattatctggtgattgtgcccataaatactccggcatcgtaccatactgtttcttcacatattcaaaaatttcttctttcttcacaatctattcaactcctgattctcctgatatcctgcccataatcataccatattttcacttcccgtgctacctgccaaattcttttgcattttcccggttctcctgactttaactaatagaggggtaaaacagcaaggacaggaagtgaggatacacttccgggaaatcccaatttagggtaccctgccctaaattgaaaaacgttgaaagcaacgatactactgtcctctcagaaaggagaacccaccaatggctgaaagaaagagaaacaaagaaatccatttttatgtcaccgaagaagaaaggaagcttatacgcaggaagatgatagaatcaaaaaccaaaaacatgggagcttatctgcgtaagatggcaatcgacggttacatcgtcaacaccgataccaccccactgaagaaacagtatgaggaaatgcacaagattggtgtaaatatcaaccagattgcaaaaaaggtaaataccaccggagatctatatccagaagaaatgcaagaattgaaagagatggtgaaagaattatggcgtatcttaaaatcttccccattaaggtaactgacaagaaagctctggactatattacaaatccagataagacagatgaaaaactgttagtttccagttttggctgttccccggaaactgcagatcttgaattttctatgacaagagaaatggcaaaaaagaatggaatggataaaggcgataacctggcatttcatctgatccaatcatttaaacctggagaagttgatgccgaaaatgcccatcgcttaggtcaacaatttgctgacgaagtgctgaaaggaaaatatgagtacgtgatcagcacacacgttgacaaaaatcatattcacaatcatatcatcttcaacgctgcaagctttgttgatcatcacaagtatgtttccaataagcggagctaccataaactctgcagaatcagtaatcgtatctgccatgaaaatggacttgccaccagcatgccaaccggagaaaaaggtacaagctataaagagaacatggaatatcatcgtggcaccagttggaaagccaagctacgtgtcgcagttgataaatcaatctggacttccatcaactatgaggaatttctgcaaaagatgcagttagccggatatgaagtccggcagggaaagcacctgtccttccgtgcaccggagcagaagaacttcacttatatgaaatctctcggaagctattattccgaagaaaatgttcgcatccgtctggctaaaaatcgtagcaaagtaaaaactccaagacatctgtccagagaagctcgcttgtatatcaatatctccacttatgtcacaactggaaatcgagagggatttgaacgatgggcaaagctcaataatctaaaagaggcagcccgcaccttcaactatctttccgaaaataacttgctgaattatgacgatttcaggcagcatgtatctgacattgaagcttctgtgaaagttgccgaccaaagaatagcacaaatcaacagtgagctgagcacgcagaaagtcattcagaaacactgcaattcttaccggctttgtcgtaaagtaattgaagattgtaaatctgctaaaaatccaaaagcataccgcaccaaacatcaggcagaataccagctccacgattcactaaaaaaagagcttcaggatctcggtatcaccaaaatcccaagctctaataaaatccagaagcggattgaaaatcttgaatctgaacaggatgctactgtccgggaaaaacaggaattgcagaaaaagcagaaaaccctagagatcattcagcaaaatttcactgtactgctcgatgctccagagatcagttcagacttacttccggcaaaaaaggaacctgtttctgtcacaagagaaaaataagattgcactggcaactcactcattttcttccaaatcttcccaaggtttcaaatccttttcctcccaggtgacaccatacggtgcacctccggaggtataaccagcaatacagaaaaatcggtcatcttgcaagatctcttctttggtcagattatctcttgcttcttttttccgttttgctcgcctctgtttcctcttttgtttcgcaacagctgctttttcttccggcgttttcctatgtccttttgccataagtgtttctagtgtaattccactctgaatgtcttttagtatacgagtttcataccctgtttcacgtttctcaacaattctatagtatgatgaacataaaagattcggtgaatcaacattgtactaatactttttttcaaccgaagttttcaatttttcaaaagcttcttcactgattacatgttctatccgacaggcatctctttctgcagtttcccgatcaaccccgacagctacaagctgctccgtaaagaactgatggcgttcataaattttctcggcaacctcccgcccggcattagtcagattgaggtatccatcttcatcgacagtcaggaaaccgccattctttaacacacctactgcatggctgatgctcggtttactgaatcccatgtgccgggcaagatcaatggatcggaccataccctgcttcttttgaagaatcagcacagcctccagataatcctccccggacgcatgaatcttcatcggttcctcctttatgcaaggctccagccggaagcctttttacggatatttacaaaatcctgataaatcccggcttttgccataagctcgtcatgggttccctgttcgctgatccgtccatcagagatcaccaaaatctgatctgcctgacggatggtattcaggcgatgtgcaatcacaagtaatgttttaccctttaccagctcattgattgcctcctggatatagctttcattatcggtatcaacacttgcagtcgcttcatccagaatgacaatcggtgcgtccttcaaaatgcatcgggcgatagagattctttgcttttcgccgccggacagagtagcgccgccttcaccgatgactgtctggaatccatctggcagcgccatgataaaatcatagcagcgggctttttttgcagcctcatagacttcttcctcggtagcgtccggtttacccatgctgatattgttgtaaatggtatcctggaacaagtacaccctctggaaaaccatgctgatctgttccatcagttcggcgagaggtacatcccgaatatctgtaccacggattgtcactttgccggatttcacatcccacagccgcgccagaaggttcgcaatcgtggatttgccaccgccagacggtcccacaagtgcggtcatggtattcttctgcatagagaagctgatgttgtgcaggacttccttgtcctgataggcgaagcccacatcgctaaattgtacttctggctgatccggctgtgcctgtgacagaatatgttgatttccgttatcgggaagttcgggctcgtccaaaacagcttcaatgcggtctaatgcggcattcatcacggtcagtcgggttgcttctccataaagagctttcagaggtccaaagagatcaaagacaaacagcagcacgcccaaaagataagccagggagagtacgccttcctgatgtaaaaaaacggataaaccgaagatagcggcaatacccacgccatagagaatgtttaagccagtggtccacggtgtcattttctgctcaaacttcgtattgacatcccttgattttttgaagttttccgttaattcgtcagatttttctccgagcagattgtaacttttgataaccccaattccttcagcaaaagacaagaccgcatccgtcaaattctcgctttggttttgacgcccgacagcctccttgaaggaaaccttattcatatattttgcaaccagtgatgccagcaaggtaatgattaccgcaatcagcccaagtctccaatccagtacgaacataaaaacagctaaaaccaaagtagacagcatatagctcatcatgttgccaatggtactcatagaaacttcctcaatgaataccatatccgtactgagaacagagctgatttttccaatattccccgatgtaaagtaacccatcggcatttttcttaaatgatttcccaactccatccgtttatcagcaaagatcataaatccagcggcactttgcagacggtcgctcaaatagtgaaccactgtctgaaccactacaacagctaataatccaagtccgacaaacagacaggtctttccagtcagcgtattatcagcaaacccggccaagacaataaacgccatgaagatcggcattttggagagaatggactcgacaaatgcacatagaaatgcagcctgaatacggcttttatacctcccggagaggttcaggattcttgaaatcaatgcaaacatttatcttccctcctttgcagtagatactttccactcggcgctgtcctgagccgctttccacaacttttggtattctgggcaagcttgaatcagctcctgatgttttccggttgccaccatctttccgtgatccataacgcatatttgatctgcgttcattatagcgggaagtttgtgagcgataactaccaaggtttttccctccaccagctccgcaatagcagcctccattttttcctcattttctggatcagcataggccgtagcctcgtcaagcactacaatcggggcatccttcaatattgcccgcgccagggaaattcgctggcgctgccccccggaaagcattttccccgcatcgcccgccatggagtgaataccttgcggcagcttttccagaaactccatacaccgggctttcttcgccgcctgcattacttcctcatcggtagcatccaaacgtccaagacggatattttccagcagggaggtgttaaacaggtactgatcctgagccacataggaaatgcggctgttcaatgcctccaggctcatatcacaaagtttatgcccgccaatggaaatgctccctttctgcgggtcatagtagtggatcaacagttttgcaagggtgctcttgccagaaccggattcaccaactagggcagttttttgtcctgcttgtgccacaaaggtaatatcgtggaggacttcgttttccgctattatcggtttcccatctgggccaggctgtgtcgtctgatacgcaaaggaaacatgatcgtaagaaatgttaaaatcctgtccgtggaaatcatcctcagcagcttgcagcggtgccgtatttaacatctgttcaagtgccgtgatcttataattcagattcggaatcgtctccataaagcccagtgctttcaggagaggaatcccaatgctgagggaaaggcagaggactaaaatcaaatcaggtaaagtgcttatgccacagagaacaaaccatgccccaagaggcaaagtcagaataacagtgcagggcagtagacttccgtatatcgccatccagggccaggcggccttataccatgccaaggtataatcccgatagtccgttacatccttgcggaagttctcgtaagattcgctctcccggttgaaaaccttgacaacctccataccattgatgtactcaatgatcgtgttgttcattttctgtgcagactgatagtagggacccatgcgcttcattccaacagagtacataatgaccatggagagcaggctgatcgggatagaggccaaagacataagagccagtttccagtccgcacaaaacatagcaacataaatcaccagcgggatcagtaaatttgcgataccctctgggactgaatgagcaaggagcaattccaagctgtccacatcatcgacaaacagctttttgattgtccctgtccctttttcctccacaatgccaaggggaagtttctcaaacttcttttgcagagatacccgcagccgcaacaatgtgttatatgctgctttatgagaaattgataatccccatccataaaaaaacgcctgcaaaacaagacagatcaaaacccctataacacgcaataaaacaaattctgtttcaacagaatcgcccataaccaatggcgaaatgacctgataggccagcacaaaaggcaggatacccgtaagaacgctgaccagtacgacaaccgtggccacatacatatttttcttatatggccctgcgtactcaaagatttttttgaacataagccctccttatattgagccgtactgtctgtgcttcaaaaacaagaggccgccaaagtaaagtggcctcttatcattatctttctgtccagtcaaggcggccctgacattcataatttctaaaattcactggcggattcggaaaaaatccaaaacctttttactgccggattcgtccaatggatagctttcttttacttgccctttttccatatggactacatacgaacatcccgccatcaccaactccggatcatgcgtaataacaagaagcgttttgccctgatccgcgagtgacttcaaactccgcgcaacttccctcatatgtttgagatcaagcccgcttgttggttcgtcaaacacaatgatctcccggttactcacaatggcagacgcgatcgctacccgctgtttttgcccgccggaaagagaaagcgggtgcctgtctttatattccagcagatcaaactgtttaaggattttatccacaacagtttcatccttgttgtccatgctcagaagcacttcatccgccacgctttcggtaaatagctgatggctggtatcctgcattaccatgtagcaatgtttgagccgggctttccaatcaagggttttcccctcaacctgcaaaaagccacacttcttttccagtccgcaaatacagcgggccagagtagattttccagcgccattcagaccgataatggcaatcgtttctccaacaggcagttctgcactcggaatatggaggctttccggttcccgctttttatacgcaaagcagaaattttgaaattccatctgtttagctgtatgcgcctgatactgattcgcaggcttcaacttcgagagagaaaacggccgcagccctatttcttttcgagtgccatccgataagctgtcaaattcagcaggcgtgtattcccgttcaatctccccatcttttacatacagcacacgatctgcaagatcgtgaaggtagtaaaggcggtgttctgcgatcagaattgttttgccctgctttttccagaggcttaggacctgccgcaggtcatcaatagcagccatatccaaattagaagatggttcgtccaggaccataattcccggcagcaatacacttgatgaagcacaggctattttttgcttttcgcctccggacagagcaaacacgcttcgccccatcaaatcttcaatatgataatcggaaactgtccggtcaatccttttcaggatatcctcctgaggatagcctaaattttcacaggcaaaggctaattcactatccgtatccacgttgaaaaactgacttttgggattctggaatacagatcccaccatagcagccaagtcataaagcggcgtatctgatacgctttttccgtccagaaggacatcgccctctaatttgccctcgtaataatgaggcaccagcccgtttaccaaacgggtaatcgttgttttcccacagccggattctcccgtgagtaaaacaaattcccctgtgtttatggtgagattgacatttctaatccctccgccgctggattcttcaccataagaaaaagaaacattttgaaaatctatcatggcaaaatccctcctgcggaaattatcggggaagcaatcgcccaaaacactacaaagcaacaaaacaagatcagcaccacatcggcaaaattgaatttaagctggcaaatgtttgtgcgtttgacaggagcgccgaggccacgggtaattgccgcagcggaaagttcctcaccgattttcacggagcaggtaatcatcgggatcagcttatactccaatatttttgaagattttttccctccaagtttaatcccacgcattttcatagcgtcactgattgcttctgactcctgaaagacagttggaaagaagcggaacatgaccgttaaggggatcgtcacttctttaggcatatggattctttccatgccggaaatcaattcactgaccgttgttgttttcactgcataggcagcaatcgcaacactgggaaggattcggcagaagaatcctattgtaaacagaacaaggaaattcaatatccccgtaaggtgcggcaaaacataaatttggacagcataaaaaacagaaaacacagcaatatagcccacagcttttgcacattgtttcgaggtaagcagcaatatagccggaaccacacaaagaacaaggcggatcagtcccatagcttctccgcctgttccacccatgacaaaaatgcttatgatgaagatgagcaacagttttgtacgcggatcgagccgcaacccttgttctgtttttttgctgagcagaatttcccgcgccattatgcaataccggcacgctggaagtgctttttgcaaatggctttcccaatcatacctccgacaaggccaaacacaaagcaggcaaccagcaaaataggcgcaatccacataggcatatatgtattaagggtagctgcatattcagcgccgtatccttcagtcagcattaccatatagctttcacggttcaggaaaatgggagcaaagttgccaaacacccagatgctgaacacaccgcaggaaagaactgtactctttgcacttttgtagtctgcctttttcaggatcacgtcagccaacaggccgccaacaagaccagttaccatagtaagatagccgttgccgaagaacaccatgattaggccaatcaggaaacccatgattgcagtcatcccgaattttttagcctttgtaacatacagcatataggggatgccgccaatcaaaggacacagcaccgccatcagcggaataaaaatggggatgaagccaagcatcgccaccagcataacaatgacgacatagatgacggtgtagatgccgatagtaattaaatcttttccctcaagccgggaactttttttctgggaactcataccagtatcctcctatctaaaaaatggtgtagttagcattttctaactacaccacatataataacaatttacgcctacatttccaacccaaaaacggttttattctacccaaaatcggtattttttaattttaaccaatcgtattttccgttttatagtttttaggaattaccccatacttctttttgaatgccgcagcaaagttactcggttttgaatagcctacaaatgctgccacctgacttacgttcaaattactttctaatagtagacttgccgccttttccaatcgctgatctataatatacgcatgaaccgatgttccaaacagcgaggaaaaaccctttgacaattttgaagtactaatattgacttttcgcgccaattcctcacaacttggtgccaaagcaagctgactgtcaatgattctcttcgcttctatgatggattctcggtcacttctggaaattgctatataagttgacgcaagaatactcagttccaaaatctcactcaaatatacagataacaactcaaaaactttgctttccaaaaacaggtatcccaatccgccgcgatattgcgtgaagtctttcagttccgcaaaaatgtgctccatatagggagtaatacctacttttgatataccttccaatagttttttctgataaacctcaatctcaccaacatcaaaatagtcattcataattttacggaaatacgacagtggtacttttacatttttgaaaaggaaatcgttttgtttggaatagcacagatattccattttcccgtgtccacgataaatacaggactcacctttttgtatgctgatactttgtcggctatctgcaatattccaggaaacaccatcattgaagcagaacaacatttgaatgtattcttcgctactcactccctgcacgttcatatctgaaaaataattcattttccagtccgaaacaactgctccctgtttcgtgaccacctgtaaaatctgccctgtccccatgtctgctggaatatctatggttattgtctgcggtgaattagagagcagatcacgataaagattattcatgtattggtttgtcatgtacaagcattcctcccgaagttagataagactaattaaattttacaacttccaaagtaaaaagtcaaattttgtaatcatgtaaaaagcagacactacttaatgtaaattacaaacttcacttacttccatttctttctgcatctcacaagacgataaagtcacttttaaaacccattgtactgacaatttaatattaattctcattattctccctgcacatcgctaaattatcttataaatatggcattttaggaacacctgacagttcgagagttaattttatctgaagttcatatttatcgtgcttttattgcaagtaataatgtttctgataatttagctgttctaaagtgcatttttgtcaattggtttaaaattttttccacactctgataattccacgacattaggctatctacagtactaactatgtttttaccacaaaaaactttataggtcaatctccatgtccattgatccatccccacttgctttatatcggtaatatacgtctcatagcgcaatcttccttgagtagccaccgatattctgcttcctactggcgcaacaagaaatttcggttctaaaagttctatcaggattgggacatttatattcaaatttttatctaatttatacaataatttttcttgttcatccctttttaaatgaccaagtactcccatgcacattacaccacttattttatctcgaaatgaatatttacctacatctatcggcaatagagaaattctctctttaacttcattatgctccattaatcttgccataaacgctgttctcatataagccgatggttctaaagcaattatttctttatcacatatcatattagccatctctattgttgtttttccagttcctgcacctatatccaaaatgattccatctaaatccttaaccatatcagcaaatttgtttaaaacaatttttttgttccctatctgtgaaagagctgataaatcataaaattctactgtctctccgtatacattctcaatttcattcaatcccgtcattctccttttttattaaatgtcttttttccaaatcataaaatatattttttatgtcaccaaaattgtcataatcaacgatattcatatagcccactttctgacatatttcagaccataattttgatacatatatttgatattgcgccatggacattttttctgttctattttgcttaaataaaatctctaaagctttctttactgcatccggccatatttgttcaaacgtttcttttactgatggtaacattacatttcctatagtaacaccagagggtatatttacttcctcttctacattaatacttagtgttccatattcatctcttggcatatgcaagaaaggaagccatattaccggaccatgggtattgaccagacagagccgccctgtggaaaatgtcaattctattctatgatataaatgtaatggatggtctatatcgttacgatccacattggtattcactataaatgttaccggaaccattccaattataccactaataactctgttaccccctcctgccatagaagttgtataagattctgctacatttcccaatttccatgttgataagcctcccaacgcacaccccaatatatctattccatcatataatacatgtatagcgcattccaaggatgcatttataagatgagcatgtttacttattatttgtgccgcctctaaaaaatctcgaattggcttgatataccgataaaatggattcaacataaaagcggcacttccggattctcttatacaattaacaatttctacctcatgagcaggatgttctaataatgttggtatcccttttgcaagtatacttttagctatattggcaccgtttccacctccagccgcattaggtacaactacacatgctgcatcaacattttgatttatttctttaatatccgtatacattggcacatttagattctttgaaagaagtctggatctatcgcttccttttcccaatatacccataagctcatattctttactttctgcaatagctttcaaataaattttcccaaatcctgttccacatactaaaatctgttttttcttcatatctttccctctgatttgaacttatctatttttttaagttcatctaacacttgatatttttcaagataacttgccattgtataaattccatccttcctaggcatttcaaatattgcattggcagtaatcgctaatatttcgccagttaaaacactcggattttttccttcaaaataaatgcatctactatcatttcctttattttgtcttacccatataaaagctttttggttgctatttttctgtcccattaatgcatttactaaatcttttttttgacaatgcgccttatttactattgaaaataaacttacaggtgccgccgtatatgaatcaatattaagcatatatttcccttgtataatttcttgaatttcttctgtaacatatggcaatatagataatttcgaaattcttgttggaagattcagcggacttcttttctgagcaggtaaaatttttccatttcgcacacatgccataggaattccagctttataactttttatttcttccacataatcgattgcggcagcttttgaaaaattatagacacctccaataatcatctctattaagtcatcattgaaagcttctttaagcacagaagacaacatccatcctgataaccccggaaatattcccgaaccaactatagcggtacctttcatgctagaattcctcatttttctaattaaatgaattcctcctgggtcaacatacggaatattctctgccattgctccaagtaacattttttcactatagtctgcggaaggtccgattgctcctattaccaaatcacttcctttaaagaattttccaatattactttccttatcaatatcaagttcaaataattggatgttgggagccatatacattcctgtatcttttattgtttctatattccgtacactgactcttaatgaatagcctaacttacttaaaaccttacacgctgtcacaccaacagtacctgttccgccaagaatacagattgttctgcgattatttatcattttctagttccctcataataatatcaaaaatgtcattactattagattcaaattctctaacgttacctaaaacagccttttcccaagatttaatagcaactgaatttccgtcaattatgcttatatctcctaaatataaatcactttcttttgctttagatggatttattaaaaaaatgcggttaataataatgttttcccccaatagttcacttgccttagttatgcataaagaagccatttcggaaaaggcaataatatatttctttttaacatttatgtcttcatgacatctttcaattatttcttgccctcccactctcttacaacttatgtttgaagcgctcaacttttctataagaacatctcttatttcattttcgttatccccaaatatatatacaacagtatatgaatttcttgtttgatttcctgcattactatgcatttgattttttgaaggatttttacaatccgatatatactgagcaatccccataattgttggcatcgtcaacgatgcccgtaatatttcatcaaatctcatgccttgtgcttcttgtatgtcactaactatgcgcccagaaatctgagataataacaaagaatcaagtccattttctaataaattatcttcataatcaatataatcatttccagaaatagagcatacgatttttttgatacttttagcaagttctacatattccttcttttgcgaaattaaagttgcttttgcattatgctttaccttgatgttcttttgtatactctctgccagtccttttctgtctattttgccattagtagaaagtggaaaactctctacatttacaaactctgaaggaatcattgctggtggcaaaaaaaaggctaactgctttctgtattcttctttcgtataggaaatgctcgatattttattttttataaaagctatcagcacacccttccctatactttgattataaaccacgcaacaatcttcaatattttgcattccacgtattgcattttctatttccgcaatttctattctatgcccattgatttttacctgattatctaatctgcctaaaaattcaatgtcgccattctctacatatcttccattatctccagtgagataaatcctgttcttttcttcttccagataaacaaatttttcttttgttaatattgtatctcctaaatagccttctgccaaagaatatcctcctatggcaatttgccccgaaacatattccggacaaattctcaattcctcgtctacaactcccatccactgtccaagcaaagcttttccatataatatagtaggcctttcttctatttcatcaatttcatgatatatagaccaaatcccaccttccgtagcgcctcccaaactaatcatttgagcgttggtcataatctttcttagtcttcctggcagactagtatttatccaatctccggataacagtactaatctaactgtcggataactctccgatttagacgcaaaagcatctaacatttccgcctgcgctggaacactattccacaaggtcactttgtattcattaagtaatctgccccaatgggatgcatctggtcctttttctggattcggtaatactaatgttccaccaactcccaatacactaaatatatcaaatacagaaagatcaaatgacagttccgcaataccaaggattgtatcctcttccgagatattatacatattttcaatagatataagagtattttgtgccgcagtatgtgacattactacacctttaggctctcctgtagagccagaagtaaatattacatatgcaataggattttggaattctggatgcttttctaatcggtattccaaattctgaagtatcatatttacttttttctcatccaattccacaataacatttgcttttgataaaattttttcttgtcgtgccaatggctgttttatatcaataggtaaataagaaaatccagcaatcaaaacacccattactgctgcaatttgatttacagattttttcattcttatcgcaaccagtccagttctattttccacaaattcttttcttaaataacctgctatatattctgctctttccaacaattctccatatgtcactgtttcaacagcatctattacggcagttttattagaattctttttcgcatacttaacaaatctctgttgaatacgagattgattcgtaatacctttatttcgttcgcaaattacttttttcttactcgcacttggcactataatttccaatggattcttccattcttccgaatgttttattccaagtattcttattgtttcagtaaaagactcaaacatctccgttacaatagattcttttatcgcaccttttcttgtatcccagcttatcatcaggcctttttcttgatcttctgaatctatctcatcgactatctgacaatcaatccatacttgaggggtatgactaaacccatattcaatagtgcctacagtgccatcagtcttcaaaacccctgtaaatacgatcggcattaataattccttttcttcagacactttactcagttctcttagcacttcgacaccagaaaaagaattatgctctaaatcctccatcaatctttttgtaatttctttgactctttctataaaactcatattttgagttacatttacttctagcaagttcactgctgtaaagtctcctactatggaattagtattatttccgatagttggtctattttgaattggtaaattgagtgtaaaatgtttattcgaactccaccttgaaataacttctgcgtatataccaataagcaccgatgaaactgttactccgtattctcctgcaatttcctttatacgtttccagtcagactgattaatatgtttctgaaatcgataaaattcatatgtattttcacacttatctgcggctcgtccatcttgtggaagaattggagcctccggtaattttttcagtctttctaaccaatacattctatcctgatgccattttaaacttcctttacgttgttgattgaacattgcataatctgaaaacttataccttattttttctaatgaagctcctttcaaaagttctcccatttcagaaatcagaagttgcacacttgcaaaatctgaaacaattaaatcaacaagtagatggaaaaaatttccttctatacgcttcgttattagcactttaaataatggaggttcctccgtatgaaaaacatattcactaaaatcttccctaatcttagataaagtatctactttttccctctctgccattttttgtagatttactattttaatttcataatcaatctcatctctctctaaaatttcaaatccgacctctgttactttcgctcttagcatttcatgcctatttaccaatactttccaagctcttgatagttcttctgcactgtaggaaccaaaatcaacctcaatatatcctttacatccaattccaccccacttcacagcttctgtttttccaactaaataggctgcttgcacatcagtcaaaggatatacattagtttcataatcattatccgtaataaactcgtctatcgtttgttttttcttcaaaatttcaattatttcttctttatattttttaactttctctttagaattttctgtaaaattccctttggaatctttatattttaattttccatcaacagtttcaaaagtaacgccttttttttcaagctctactaataattctcctgctacttttttcgtgtcctgcattttttaaatttccccctcttctacaaattctgctatatctgtattttttctcttatcaaccaattttgttagtgcgttaattgatggattcataaagacctctttcatgcgtacctctattccgcaacgagcattaatagccgcaacaaatctagccgcaagcaagctgtctgcacctatcttaaaaaggttctcatccaaatcagccactttatttttcaatagctcctcccaaatcatcagtacaatatttaatactttgtcagacattatttccacactatcagttttctgatattctgccaatcttcttctatcaacttttccatttgcattaagaggaaaattttctaatctgtttatagaattcggtatagaatactcaggaagatgtatcttaagataatcttctatttcactctctgcaatgtactctcccaagtaaaatgcaactaattctttatggtatttatccccctgagcaacaactacggcttcttttattcttgaaatactttttaatacactttcaatttctcccaactcaattcgatgtccacgtatctttacttgggtatccattcgccctaaaaactctatcgttccatctgcccatcgccttccccgatctcctgttctataccaacgttccccttttacatccgtaataaactttttcattgttagctcttcatcattaatatagcctttcgccagacttccacctccaatttgcaattcaccaggaatatcaactccgcactccacaaaattttcatccgtaatcctatatttctgttttggtaatgcttgcccataaggaatagaattccacaatttatctacttttgaaacgcaataatagttggaccaaattccgccttctgtcgctccgcccaacgctacaaattgcgagtttgctgaagttactttataccatttctccggtaaatataaaggaatccagtcccctgacactaatgccaaccgcaatttaccaaaatgattattttcccccattatcaaaaacatgtccaataacgcgggggcactattccaaatagtaattccataaatctctatcagatttttccatacttctggatctctaaagtcgtcttcatcaattaaaacaattgtccctccaacagttaaaagaccaaatatgtcaaaaaccgacaaatcaaaatcaaatgctgatatatttaatacggaatcttccgcaccaatattccacatatgtaaaatttcttctattgtattcattgcagccacatgactcatttctactcctttaggttctccgctagagcccgatgtataaataatataggcagtatcttttgaattattttcaatacacccagtccatggattctcttctaaaaaggcttcatcctgcaatacaagagccggcttgacattttctatgatttttttccgacgtcctaacggctgcttcatcgcaatcggaacatacgctgcacctattgcaagaattcctaacaatgcagctacttgtccaatacctctcggcaatataactacaatcttatcatttcttcttactcctctttgccacatatagtttgctgcacgcaacgcatataaacgcaacatcttataagaaactttctcattttcatagataagcgcaattctctctggatatttcaatgcattttcataaaattctccatgtaatgtttcctttctattagaaaactctcgatcgttcatcatatacatttcctttcctcaactattccacattctttttaagccattctacgactctcacaataacctcatcttctatagtaccgccttcatcctttaatggagaacttaccttagaaagtgaatgtcccaaccctttaaacaaaattatatctgcattattccttgctgcctttgctatttgcacagcttctaccggagaaatccatccgtcattcaaaccatgaagtactaaaataggtaattggattttttttatgtcatctaatattcctgcccatgtttctccaggagcattttcagcaaatcgaattaaagtagtaggatctgcaactatttcatctgccaatggtatccaattatctattatgctgaatcttcctttcccttctggatcaagttcttcattaaatttcatatttccctccttatccgtaccaagaataagtaaatacagagagaaagagatagatgtggagtccggtatgcaattcaaaaaatccgaaatttctaatatgctatcattattgttatccaactctttcaacttttctactgtaagttcgcgcaatatataagagaaataggaactccatccttctgcaatacccgactgaagaatcaaagcctgcgcattcggaaaatctgaaactaaagttgtacaaactcgtactccttcactccatccataaaacagaattccttccacttcagacaagccagaaacaaatctcgttacctctctggcatcccgaataattatttctatatcataattttctcttttatcataacgaaataccgcatatctagctttcacaaacccttcgctcaataaatcaaaattacgggatactatacctcccatggattcaactgtagcgtgccgatcagatggaccggaaccatgaaataaaataatcgttttccattgaccttgcctttctggcaaatctaattctcctgaaattttcattccattttccaaagtaatttccaattcttttacaaacatatttttattctccctaatatttttccataaatttctttatattatttacataagcgccaaaaatatcagtaatatattgtttatcaaagatgtcaataatataatcccatgaaatcttcaaatatcccaaatcatctcttacatggtgatctaaaaccacctgcggtgtttggcttatcgcatattcttctttgaatgaatatcttttttttgttaccttagacacattcccctccagcatacaagtaaacactactggcataatcgcttttcctgctctacctgaagaaagcatttttaatatattgcttccttcaaattttctatattgaactaaccgccacatctgttcttgagttgctcgaatagcatccaataaagaatccgttttttcttggtatgatattactgcattgttagtaaattcacccagtatcccattcacatcttcatgcaataactgtctattaaacaatgttacatttatggaaagtcctggagtttcactatattgtgccagtgttttcataaaaattgtagaaattactgcagcaggagtaaaatgatagttttttattttctgatataatcgttgtgtttctataaaagaaaaatcacattcaattctatcaaatcttacattctgcacttctgcaaattttttctggtaattcagtttgggaaagctcggcatattttttactttttctttccagtattcttcagcttccaaatctcctttatctgtttttaatctcatgtaattcataaaagagattcgtggaaatttaacatcttttccatagtacaaactgaaaatctcgttcaacagtaattttgcactccatgcatccaaaataatacaatcaaaatctacatgtaaaacacttgtctttcctgatgttttcccaacgcaaaaatggaacatgggccatttataataattatacctatgatgacttctctctagccgcttttgctctctatcattcccatcatataatgaataaactggcacagaataatatggcacattatctaaaaaactcgctttcccctcatgtgttacaatcaaccgtaatgcatcatttttagaaataaccagatttatcatttgctcaagtcgttcaacatccaaagattctattgtatattcgatgtaataatgcgcatttatatttcccaactcacacccagccgtttgtcccacaacataagctgtttgtattgatgttaatggaatcacatttttttcgatcattcgaaagaaatctaaaatttgacctttagccattttaagaatccttaatgtttccggtgccaattgtctgtttttagatctgtatcgaattttctccccttctccccaaatttgaatgccattctctctaagttgctccaaaaactccaaaatatcggtatcattattaaatatgtatttactcattacgtttcctctaatatatatctttcgattttgctgatagtcggatactcaaataacttgccgatatccataaaacaccctattttctccgtcatttggttagtaatttgtattgcctgtatcgaatttccacctatttcaaaaaagttatcatttatatcaatattttcaatttttaaaacttctctccaaattgcgagtaattgctcctgaagttgagtaagctgtttacaattattattctttttaaaaataggctttctatttttttctgcaacaatcaaaattttatgaatatcctttttcccatttgaattaagcggaatagcattcgttttaatatattctgttggaatcatatagatcggaagatctttttttaacatttccttataaaacttgtctatccggtcacgataccttttttcctctactaatacagcacatatgtcttctatcgcattatcccttttaaaaaaaacaaacgcttcagttataccttgaatccttcgtaatgcagcttcaatttcgcccaattctacccgatatccattgatttttacctgattatccaatcttccaagaaattcaatattaccttcattccaataccgtcccacatctccagtacaatacaatcgttccccagttctatctaaaacaacaaacttttcttctgttttttcattatcgtttaaatatccctgtgcaacgccatctccggcaatataaagtgttcccggtacccagtcagggcaatcttccatattctgatccagaacataatacttctggtttgcaagcggtttcccatacggaatactcttccaatcttccggcacaatctctgggatctcgaaatgattggaccaaatactgccttccgtcgctcctccaagtgcaacaatctcaacattctgaaacagattacggattctccccggaagtgaaaccggaacccagtcgccactcatcattaccaaccgcaacgattgtgaagttacctgcctttgatattcctcatattctgccagcatttctacaaaagctggcacgctgttccatacggtaatattctcatgattcaaccagtgaatccaatgcgctggatcttttccatattccggatccggaagaaccaatttcccacctgcgcctaaaacgccaaaaacatcataaacagacaggtcaaaatgaagattggagattccaaacgccgtatcctgttctgtaatctgatagcgtgcattgatatccagtattgtattcactgcattatggtgagtaatcattactcctttcggcatcccggttgttcccgacgtatagattacatacgcaaggtctcccgccttattctcctgtgctttgtattcagaatcggtttttaatccagacacagaaatacaatcccactcgtgcagccattcggtatcctgatcatacgcctgattctgcacaagaatgattcttgttccactgtcacggagaatcttttcaactcgttctctcggattatggatatctatcggaagatatgcggctccggcaaacaggattccataaacagcaactacctgctcccaccctttttccataaatacagctaccgtctcttctttttttattcccatgctcttcaactgcccggaaatgtaaaacgcctcttcttttatctcccgataagtcatccgcctgctgcacgttaccagcgcctccttatccggaaatttgtctgccgcctccaagaataatccatccaacgttttctcttcaaattcagccgccgtttcattcgcctgacgccgtttttctgaaatttccgctgttaccagacttgccgttttttcctgcatgatctccggatgaactgctagcgtatgaagcaggccggtatatgcccggaacatctcatccagcattcccggataaaataattcgtccacggaatcccaaaacaggcataaacagccatccatttcaaccacctgatgatccagccacacctgcggcgtctgtgaaatgttatagttcagttttccaagccactttccttcattccactgctccacgccaaggccactggtaaacactaccggcataatagcgccccgcatatttccagtctttttctttaattcgcgctccagttcaaccgcgccataagctgtatgctccagatcttctgtaagctgcttctgaattgcctttgtcctttccgcaaaattattccctgcattctttatctccagcaatgtcagtgttgtaaaatctccaaccagattgttcacttccggatgcaattgtttccggtcaaactgcgtcagattaagtgtaaaatccttattactgctccacaagcggagagtctccgcataagcactcatcaaaagaacagaaggcgttacctccagtcttcccgccgcgtcttttacagactgccattctttctgtgacagttttgcgctccggcgacagaaacgctgctctgtaatctggctttcgttctttgcaagcggcagatccggtgcgtccgcaaaagtctccacccggtcttcccaatattttttatctttctcataagcagaggtagactttatctgctccagtcccagcacgtaatcccggaaagacaaagtaatcggcatttccgcttttccatttcgatatacttctgcccactcatttaagagatggaacatactccagccatcaaagataatattgtcaaaactgatatggattctatgcttctggtcctctattttagtgattcgcacatcaaacagaggccattcatctgtctgaattacctgatgagacatctctgcccgtttttcatccaatgccttttctttttctgtcacttccaattgtcggatatccgtcacgtcaatatgatactggggagtattctccagtatgcgctgcataccatccggctggataataacacgcatcatcccatgcctctgtatcaacagattccatgccgtctctgcgcactcagtatcaaggccgtctgcatccagttcaaaataacagtgcgttgcaacattccccaattcatacaatccgcttctgccaagccagtaagcatactgcacatcggttaatgggaacggatgatatgcttcctccagattcggtttgatctgcagtgtatcttcttctttctgttcggactgttcaatagcttttgccagagattttacggtcagattttcaaaaatcgtgctgatcgttattttgcagccgaaggttttctgtacttccgagatcaaccttgtggcaatcagcgagtctcccccaaggctaaaataattatcttcaattccgatattttcatatccaaataattgtttccagatatctaaaagcttttcttctgtttctgtcgttgcctttgaaaatcggataaccgcagtttcttctttaaaatcttcccgcaattgcttcctgttaatcttcccattggacaatgttgggagctgctccatgaaatgataattctgtggaaccatatactccggcagtttttctgacagatattcccttagtgctccattatgataggacaggacagacgcctgctgtctgctgcagcatatacatcttccatatctctctgtcacagcacagtcttcgcccaatcctgcctctgataaacattctctccacagcaggcaatccggggtaaccagccctgcttcttttctcttgtcccgaatatccgcaaaaccattttccaaaaaagccgctgtaagttcctgaaggtatgtccttaccacaaggtcagtcatcagcaatattccgtttggcttcagtaattccgctactttctttaccgcatcagcagcatcaatatttctatgtaaagcatttaccgatatcacaatgtcataactatgcaaggacatctgctgcttatccatgccttcttccagattcagcatctcaaactcgactctctcatatcccgcaagttctttctctgcttcctgcagaaaatattttgaagaatccgcataagtataagccacgcttacatcttccagtgcattcaaaaactgtcttgtaattgcagtgtcccttgtaccaatttctataatctggagtggctcttttctgcgttcttctgccagaagccttaatccctgcaccagtctttccactgtttcctcgcagcccggaatcctccgaagcagcatattcggagccaaagccggctctttctggtaaaatacgtccagcggaacttcattcccagtaaccatatgcttcagatacggcttcagtttattaaaatacgtttccgtatctccagctttttccggtacagccacttccttcccggtacgcgatagtctgccgtcctcttctctcaggattccttccttctttaaaatttccaaccatcttgccacagtattcttctgtgtttccgtaatgctccctttttcaaaaatttccttctgcgaaagaacttccttctctgatacaaaaatgcctaactctatgagtgtctccagcataagctgtacacatctctggtctgcataggcaaggaaatttttgtatgctgtcttccgttcctgctgcatctgccaattgctgacatcatccttcagttctttccagcccccgccaaagatatctgtgccgtacaaatacgttgtaactttagaatcttcctgtatcggcgctccgatataagcagccagcgttttattgccatgaccatcactaactgtatcaacaactgcatgagccacacccggaaactcctgaatcgcatgttcaatttctcccaattcaatcctgtgtccacggatctttacctgatgatcttttcttcccaaaaattcaattatctcatcatcccagattcttccgagatcaccggtccgataccatcttccatactgatctgtgataaatttctgccccgtaagcgcagaatctcccctatatccttttgctacaccaaaaccgccaatccagagttcgccttctgcccagtaagggcaatcccttccatactcatccacaacacgatatgcctgatatctgagtggctttccatagggaatagatttccagtttttcggcatcggcagggtaacattctgataattggaccagatacttgcctctgtagctcctcccatagcgacaaactggcaatcctctgtccatgccgcaaccctctgcgggagatccatcccaatccaatctccggaaagcataaccgccctgatcggcagtttctgtttcatggattccgcccgtatcaaaagcatatccagaagcaccggcactgaattccaaacggtaatctgatatttcaacacttgttccagccagtaatccgcattccttctctcctgctctggaagcaataccaatgttcctcctgcgcctaaaattccaaaaacatcatataccgacaggtcaaaatccatagctgatacagccagcgcccgatctgcacttgtcacatggtacttttcattaatatcctgaaccgtattccatgcgctttcatgcgcaatctctacacccttcggaacacctgtagagcctgacgtcatgatgatataggcgctgtccttcggcgacacctctggcagtctcacattttcctgtccctcttccataccttccatcacaaggatttccgtaccttccggccagtccagtttttcggataattcccgattcgtgaccacatagcggactcccgtcttctcatggattaacgctctccgatctttaggctggcttaagctgaccggaaggtatgaatttccggaaagcaaaattcctaatgccgactcgatctgttctatcccgcgcggcagggtaagtgcaaccgggacgcccttaatatccttttctgaaattcctgccgccactgctgttgcccgtgcttttaattccccataggataccgatcttccgcttcccgcatcaataagcgcaatatcttccgggcaaacttccgcatggttcataacagcccaatgcaggcattccacacgctccggcactcctgtacgcgctgtatcttcaatttctctttttcttttttcaggaagcacatcaaatctctgattccagtccttctttcccaattcatgcagaagaatctcaaaactctccaacatatccgggatcatattctccgggaataactcatccacgctgtcccatgtaagctgtacgccattttcatcttcataactctgaaaatcattccacacctgcggcgtctgggaaatcatataggaaaactgccccagttcattccggaacgtatcatttaccaacggcgttcccagattgcaggcaaaaacaaccggcgccactgccgatgcgtcaccacacatctgcgcaatgtctctctgtacttgcacgccggaatatgccgtatacttcatatcctcatgaagctgcttctgaatcctgtccaacaattccgcaaaagtcggattttcttcgcagttaatctccagcaataacagagtagtaaaatctgctattacttcctctaacccctgctgctctgttttccggttaaaaaacggaatgttaataaggaaacaatgattcctgctccatcgttccagaaccaccgcatatgcagtaagaagaaccattgccggagttgtctggtatttttttgcccgcatttgcaaatgatcccattcttccttttcgattctcacaatcctgcggttgaacaccgttttttccacttcttgcggacgttttgccaatggaaggtcagggccttttggcaaatgctctaaacgattcttccagtatttttctgcgtttttccgttcctccccttcttcctgtttctgccgttctagataggaagcaaaattccacccttttgattctttcggcaggttttcccctcggtaagcagatgccaaatccctcaataatatctgcagactctgtacatcagcaaccaaaagtgccatgtccacatgaaggcgtgccttattttcaggaaaaagcgtaagctctattcctgctacttcgccttcctcaatctttaacttccgatgggataaacgttctctgacagatactgccattgcctctgcttcctcagatgacatccgggaaaaatcatgaacctttattttttcacaatacggcttatccaggattttctgtgttccatcatccaaaaagcaggcgcgcagcataggatgatgatactgcagtacattccatgctttttccagacgctccggatctatatttcccccatcaaactctaaatacgcatgacagtctattcctccaagagcctgttcttcatccctgccaacccaatatgcatactgtacgtctgttaaaggaaacggctgtttcatatccttttccggcgttatcttagattcttgcgcccgttttttgcccgcttttttcttcatgctgcgctggatcagcgcccaccagccttcaagggtaggattttccatcaatgaaccgaatgaaaccttaaccccctgttttctccactggtttaccagacgcatgattgtcagggatgaaagcccaagctccagcagattttcggaatcccccaaatctctggctaccggcagcttttgtttgatctgttcctttatctctatatattccatgattctgtctccttctatttttcctgcgccatacgttctaatgctttcttatctatttttcctacgctggtcagcggccatgtctctacccgttctatctgatccggcattttatacgccgcaacgcctatttcccgcaggaacctgtgtatttcctgcaaatcgatcccggcttcatcatcggtcacaaggaatgcacatatccggtttccaagggtttcatccgtaacgccgacaacggctgcctctttgattttcgaatgcctgcaaagataagcttcaatctctgaaggcatgatcttttctccggcgcggttaatctgctctttgatcctcccgcccaaacgtaaccttccgtctttcgtccacatagctttatcgcccgtccggtaaaatccgtccgacgtaaagctctttttattcgcttcctccgccatataataaccatcaatcgtatacgggcctctggataataattccccaaaaactccttccggtacggccttatcttcttcatccacaatcttcacttcatccgcaggagacaccggagttccctggcatcttgcgatcagggaaccttcatcctccgggctagtaaaggacagtagcccctccgccgtaccaaatacctgcatcagtttacacggccattcttcaatgatcttatccgcaagggaatcttccagcattgcgccgcccacctgcaaaatccgcaggctggatatatcataatcttcatcccattccagcatttccatgcacacagtaaccatagcaggaaccaatgccgttatcgtgacaccttcctctgtaattgcgtcaaggatatcatccgggctggtcgcagacgcaagcacaacttttcctcccacgtccagcgtgcctaaaagccccgggcagcataacgggaaattatgagctaccggaagagacgccagataaacgtcactgctatccagacggcatctcttcgcggacatgcgggcattatacatataatccgtatgggtgcgcggaatcagtttcggaacccctgtcgtcccgccggacagcaaaagcaccgccgtttcatacccatccacagccggaaatgctccattttctccatacgtttccgcaatcattccactgatatccccggattcgctatctacaaatatatgccggatacatgaatatttctctttcatcgcatttgccatcggcacatatgaaaatcccagatatttctccaccacaatataagcggccggctttgccagttcaataattccttccagttccgcctccctgtgggccggcagcatcatgattggcaccgccccaatcttggaaagcgcaaaaaacacgatcacaaaagaaatcctgttcggaagctgcacaagcactttgtctccctttaaaatccctttacgcagaaaagctgccgcaagacaatctgctttttgctttaattccatataactgatctcgtcttcactgtccgtgaccgcaattctttctccatatttttccgcccacctatcaagctgttctccaaatccacatctctcccagccttccagattctcatatttgctcatatctttcttataacccattttatctgtctcctttcttatgcgccgccacatacgcagcatatcctttgatcctgaccggatacagaaaccagtcctgatctttcttatctttttctgcaattttctcgtttctgacagagaagaaatccattcctcttcctaatccaattccaagcgcctttacatatgcctctttcgccgcccagtactgaaaaaacagatccggtccttcattttttacatcttccgcttcttctgcagtataaaaattttccgctatctccctatagtccgggcactctgccatctcctgcacatctactccgatatccattccgacagcgaataccgccagtatgaattcacccgagtgcgaaatgttaaaatccactgtccgctttcccgcaatctttttatgataaggcttacccagttcattgacagaaaaatcaatcgtttccatatctaagtatctttttaagaggatccgcacgacaaccttcccggctatataacgcatcctgtcttcaggaaaacggaatcttccggcttgctccaattcctgcccactcaggatatattcatggttcttccagaaatctgtcatttcaggccagcggatacaccatatatgtatctcattttcacggatataaagtttgtctgctgacagaaattccttttctccgtatcgtttaatctccatttttcattctctaaagcagtctcatgacctcacttattacttcgtcttcacaatccctcagataaaaatgtcctcccggaaatatccggtagttaaaatcattgtccgtatactttccccattccaagatcgcactctcatccgcttcgtcgtccttttctccgccaaatgcagagataggtgtatgcagcactactcccgctttatcataatacgtttcatccatggtaaaatccgcccgcagcataggcagaaagaaatccaacaattcctgattctctagtatctcttttggcgtcccttcaaatcttcccagttccctcttaaacgcttcatccggaagatgatagattggatttggctccggaatactaggaacccggctgccggaaataaacagacattttgcagtatatcccgctgcctccaaccgtttttccagctcataagagatcttcccacccatactgtgtccccataaggcatacggtccgtacacaacctttcttacagcctcttccaggtcatctaacataaccgacatatctatatacggtttctccatgatctgttcttcccttcccggaagctgaactggacataccgttactttcccctgcatctttttcgcccactggttataagcagaagcaccgcctcccgcaaatggcagacaaaacaaggttattttctctttactaatattttccgtattttttatcaatttcatattcacttttatattcctctggcataatgttctttttctctctgtttaccatcattttgtaatatgtttttctcaatcacttcttatttctacctgtaattagttatatctaactctttgtcaaaaaaatttttgatccatcccaatatcaaaccggacgccaaaacaatatgcgctaccataatcccgtttacgatcagggaatatccaatcacagaaaaaacacctgctatcgcgcattcaataactaaaattaccctcgcgcgcatcccataaacttttttctctttcgcatccaacttcttgctgctggcatctaccggcgccatgataaatataacgccaactgcgacaaaccatatgatccgcatttgccatattacagccggagcagacgccagatacagactgcatagaaggacaaggataccggaaacagccatgcagccccctgccttttccaaatgaatccctccggcatactgccttaaaacagtaaagggcaataaaaagactatcatctccatccaattccccgttatgatgccaagtatgacgatgataaggtatattaccaccctgcccagcagtacgccgtaagcatattcatacagcctgcggtctttctcttcaagaatcccattcctgctttgtagttcaaaaagccggccagccatttttttccacactagaatttcctcattttcttaacttcttccggctcatcttcctgatagtacagccagttgcacgccagatttgccgtatacgccgtcaagcagagtgcaagacagtttacagctccaagcagtttgattcccaggttttttctgattatttttttcatagttacaaagcctccttttttccgaaagtttacacaaaaatcgccctcttttcaattaccgtggcaaaaacggtaactttttgggcgatttttgcacgtccttatttgattgtaaagatcagcttaacagagaactcccgttctcctgcctccactcgcataattcccgcatactttttaaccagttttccaaccgtgtgcagtccgatcccgtgactgtccgcgtctcttttggtgcttatgtacctgtccttgtcctttaacagagggacgacatacccattgcaaaattccatgacaaggaaatgccccgcatttcccatatacatcctgcattccacatatctgccatcttctgtcttttctgccgcttccagtgcgttatccaaaagattccctacgatcgagatcaaatccaactcttccagaaaatccagtctgagatcattacccagggtaatcctataggatatatccttagattctgcaagaaattttctttcacataggatgctgttcaagatcggatgctcacaatatacacttttttgaagattctgaatccggacgcctaaatgttccatgatgtccttaacctcttgattctctccttcttctatcaagccggctactgtacagataaatttatttatatcgtgtaagaatgctctgttatcctcattaaccttattcatatactgcagattggcaatctccgccctgcttttctggtatagccggtccatcttcttcacttcttctgatttttctacaaacctgtcaaatactgtgaaaatgaagatattcgtcattaacagaagcgaagctcctaccggaaccatgaccctgttcattccttcaaaagaagtgtgcgaataaaacatacatcctaacataacgatcgttgcggttggcagcatgagcagcactgtaaatgttttattttcaatcgtcagataatcccttttccttgttacctgattaatgcatttaataaacagaaatgtcatggtactcatcagcaggagtgctaatgtcttttctgtttcagtcctgaagccctcggacgcaccagtcacgccatatgcattcgtaagtgccgcaaagagaaattcgggaataattgccagcacataatagcagcataccgtaaccagcttcttccatatatttccccggaacacaaccatagacgcaatcatatagattaccggaatcattaccatattaagtattgaggattccaggcggttggttccgaacattgccagtgctgcgatacaatatacgagaaatttttcccagaatctttctcttctgtatgggagtatgttcttttccaagtcctccaacagatacatctgaagaagacaaatcaaataatctcttattatcataccatgccgttcctttccccaagaaatgttatcagtgcgtcggcaaactgtccttttctcgacctcgaaacattcaactggattccaaacggcagcaacgcaacgttcttttccaatccttccacttttgccaaattcacaatatagctgttgtgtgcatactcaaatccccttccggccagacactcatacagatcacttaaagattccttgcaatgcatctcttctatctttccctgtctggcaatgtatatcgtacagccccttttcgccagacagatatataaaatgtcttccgtatggatgcgcattatccttcccgccgatgtaactgtcacggaagaatctccacagcacaatttcacttttaataaaatcataggtatttcctttttcagacttctgtcatgcagatccttcatgatgtaccggaacggttgtccaacattaatgctgtcaggagtcggttcaaaacagccggagcagaacaccaatatcgctgcttcattatattccctcagcttcagtactgttttatttccatccaatccaggcatacgcatatccataaaaatcagatcatgcaaaatatccgcatcttccaataattcttttcctgattcatattcataaaaccgtatctcattcgaagacagaatcccttccgtttctatgaccgtctttattttctccctgtattctttatcatcgtcgcaaattgctattttacacatattcatcctccagtgttagtttcttctaaccctttcccataaaaaaaccatcttgcagaatctgaatcctaagattatttgcctgttcctataactccggttccaaatctgcaaagatgggatcttcaaaaaattcctgtattgtaatatccaatccatcgcatatctttttaattgtaactacgccagcattcctgctttgtccatacaaaatatttttcagtgttgaaggcgggacgcctgagcgcaccgccgcttcattcactgtgatatctttctgcttaatcagatcgtttaaccgatatatgaccgctgtttttatatccacggtatcgaccacctttttttcttctattttatataaatcggctttaaaaggtcgcccatatatagtctttttgatctatgcacgatatttttttaacagtttttcttattctagcagaaatccgctaaatttctatattttattagatacatgaaaccctgtgagaacatttctgatcctacgcagggttttccactttgttataaaatttttatattttgcagtatgctggatcggagttatcattcaactttccttctgctgccgattgtaaaaacatatttttacgaataaatattcagcagttcttccggagaaagcagtgtaatccaaaaggaaagaaaatcctttttattccttgtcacaatcgcatcacactgattctccttcgtacaagttgcaagtaggcagtcttcaaaatcagatactctctgcaaataagcaggcagcacatcttcgttcgtcactgtcagcacttttgctatgtccaaaacggagccaagtgcctttctataaatttataccgttcttacatcccgatcagctcctctctccagctcatcttttccctgcttttcttggatttttctcttattgatttccagtcgttcatgaatagatggcttctttgccttcgtagttgctttattcttttctgtttgcatactcgaaactacctttttcacagctttgtcattatccccttttgtcacattcgctgctcttgacgcttctactctgctgtcctgcttttctgcaacctgccgttcctgcttttcctgcacacttttttcttccagactgcaaaagctctgcaaatatggcagcacatggttctgcatatcggtcagatcttccatacacttctgaaactcttcatttcccttgtttttcagataaccaatccagctttcatccgtaagtttcagttcattttggagtttcagctgacttaaaataccgccatttcctgttccaatatctattttccctttgaaatgttgcatcattttatcgcctttttccgcataatatatagtaaaaaacatctgggctgttaccatcggctcatccgtcctcggattacggtctgcgtaccattccttatccttctgtgcagtacgggaatccagatctgagagcttctgacagcgtggttccatcagctctcgcttttcacagtaattcacatacaccatcggctctgtttctttggatatatctggttcgtaggatttcagccgttccagcaaaacacctgcccacacggactgctcacagtcttcttcaatcacatccttcagaaaggaaatataagaaccaacatttccactttgcagatccagcatgacttcctgtatggtatcctgccctggctctacatggtcccgatagtcatacggatcgaagtcttccgcaatctcatccaatgctgctgccagttcttctgttgtcatttttttcggatacattgcctcacgcacatcctgaatcgggatatatttataatcaggcaatgctttatgaatcttctccaaaccttcacgcaccaccggctgatcttttaaaaaccgcacattatccaagaagtcgccgtgtatcgttgttcccattacaattaacagttctgtttcatcaaacaagctatcctccggatcacgataaataatccccattccactgcctttataagcgttttccggatcttctctgtacttctcatagattgctgcgatttctttcacatctgtgcttttctcataagctcccatatcatgaatttcatcacattctgcagcataatattccagataagcttctttcttaggcggcatattattgagtacattatcaatcatgttataattggcctcttccagttcctccacctttgccaatggcttatattcgccctggcttttctgaatctctgccattacaacttcatccatttcttctactttctccatcaaccgatcataatctccacggatgcgttctccagtccagccttcgtcttccaaaagttcctccgccgcttcttcaatagaaatttcatcattctcataaacgccaccatccatcaagcggaaatcttcatcgtaaaaggaataatcatatccttcttctgttctctgaatagcaaagtaacgttctcctacctcatatgccagttcactaaggacctgttcttccagattcaggaaagaatctagctgttcaaaactgatactgtctacaaaatgagcagttactttttccccgtcattcagaactacgatatcactgacagacagggaatgcccacggaaatcttccggtctatcaatgttgaacctttcaaaaatatcatccagtgacatatttcctgataattcaccaacatagaccagcttgtaatcttctttttttatcttcataccatgactttcaataaaactcatattcataaaagcatagttttcgcccggtgaatcatcccggatctgataaataccaaatacccttcttgttcctaacaacaggtttgcttctttcaatgactgaatctgtggatatttctgcatttcccattccaggttacggaaacgctccagttctgtcatagacatctgataatgctctggtcctcgttcaatttccatacgttctgtgacatacatcggtgatgaaaaattagtgatcagatagatatctgctcctgcatcgtataatttcagtgcttcttcctgctcaatgacactcataggctcctgaaatgctcctaaattttcttctgcataatctaggttgttatcctttatccgttcccacatctgcaattccattccaaacaaaccgtcgtgtgcctgtatcatttctttactcgcatattcacctttactgccatcacttccaaggcaataaatcttagaacccattctgtgataatccaaggctgcttcttttctaagtggcaccatatcttctgctgtatatccatagtcacgtaattccagcttacctatggttggatccagcagttcttgaatatccattcttgcgtcatccagcaaatcctctacaccttcttgatctgcctgactcactgcatctgccagatttcttaccaaattcctaactttctcttcctcgccgatcagattcgcatattcaaaaatctgttcttttacatctgttgaaaattctatatctctacgctctgcctgagcaatccgttcctgcgtatattcctgcattttctgcgtttcttttcctgttatcatatttctcgccattcaaattcctcctgtgttctaaaaaatggcataacaggcagaaccttcttctaccaaattatgccatctttcctgtttatttattccagaccgaagtcccgttttctgttttccttgccagtttcactttcccgctgactcttttctttataaatctgcagtttttcatggatagaaccacgtgtcggtctttcttctttctcatctgattcagacacctctgtttctgcatcttcccgttcatccatattgagcaatgcatttaattctgacagtcgctccagtttctggttcaactcctcttcttttggaaatggctttccaacctcttcttttgcatttgcaagctgttcatatactgtttccagtctttgttgtgcttctgaaagcttctctggataactgtccaacagattgttgatacgagtaatatttccaagtgcatctgctccaagatgaactttcgagacagcctcatgtttgacagatagaataaattctttactccatccatcaaactgaatcctcatattgaatccctgatagtttccgatatccatcgcagcatctacagctttaatatctttacataccgccagaagtgctgctcctgcctctttcttttctgtgaactctttgccgccaatctccatagtaaactgctctggatctgtgattttatgctctgagtaatgagcgatgtctgccttgtagctgtcaatgatttctgtcagttttgcaatctgttgtggaaaattccttgcaatatcatcttccaggcggtactggttattcatgtggttggcttttaaaagttttaattttgccacatcaacatccaatgccatcttctcttttactgctggatttccggttgcaagagctttgacctctgcataggaaagtgccgcttcgtccacatcctcacagcttcgcacaggtgctttgctggtcataatctgagaaatgaatttctgcttgttctcaatcaactgccacatgtagctgtcaaatgtggattcagttacataccggaagatatgaacctttttattatgatttccctgacggataatacgcccttccctctgttccaaatcagatggtttccagccaatatccagatggtgcaacgcaatcagacggtcctgcacgttggtcccggcacccatctttgctgttgagccaatcaaaaaacgaacctgcccggatttcacttttccaaacagctccgtcttctttgcttctgtatttgcatcatgaataaaagcaatctctttttccggtacacctttcgctatcagtttctgcttcaagtcatcataaacattgaaactgccatcacctttcggtgtgctcaagtcacagaaaatcaattgtgcagatttctgtgctgccgtgtctttccagatctcataacttttctctgcacagactgatattttgctttctggattatctggcaataattcgttcaccaaacgctgatccaatgccaattttcttccatcattggtaattttcagcatattatcaaccgaagcatctacccctccgtttctgacaacttctgcacgttcccccagactttctacgatttctttctgctgttccgttggtttcagcaccactgtttcatattccgcctctggcacaggaagctttaactgatcggaagtcttgatatctgcaatctccttaaacatattcatcagttccggaatattataaaatcttgcaaatcttgactttgcacggtagcctgttccttctggtgcaagctcaatgctcgtgactacctcgccaaaggtggaggcccaggaatcaaacagtccaagtcccatattttgtaatttgctgttctgcagatacctctgcataacatacaattccgtcatgctgttgctaatcggtgtgcccgtagcaaaggtaatgccttttcctccggtaatctcatccagatactgacatttattaaacatatccgccgacttctgtgcttcattctgtgcaatcccggctacatttctcatttttgtataaagaaatgcgtttttataactgtgtgcttcatctacatataaatgatccactcccagttcttcaaacgtaactacctgatcttttttctctttctgattcagtttctccagccttgtctgcaatgtttttcttgtcttttcaatctgtttgacggtataacgtccaccatcctgttcataccttgcactctggattgccatttccagatcatcaatctgcctctgaagcatggcttcctgtttctcatcagagattggaatacgctcaaactgggaatgaccaataataacagcatcgtaatttcccatagcgattctggcacagaacttctttcgatttgccggttcaaaatcctttttcgttgctaccagaatgttcgcccctggatataactgcaggaattctgctccccactgctccgtcaaatggtttggaactacaaagaggtttttctgagataatcccagacgtttgctctccattgccgccgctaccatttcgtaagtcttcccagctcctactacatgtgccagaagcacattatcaccgtatagctgatgtgcgactgcatttttctgatgcggtcgaagttctatttccggattcattcctgggaaagtcagatgacttccatcgtattcacggggacggatactattaaaacgttcattgtacacgcttaccagtctttctctcctctgctgatccttaaaaatccaatcttggaatgcagccttcaaagcatcctgcttttgtgatgccaacatagtttcttttttattcaaaactcgcacttcatccccattgtcatttacgactttatcatagattctaacatcttttagattcaaggtatcttccagaatccggtaggcatttgctctctccgttccatacgttgcataggcaaacgcatttcttggactgtcggcgttctttcctgtaatcctccactcaccatttatctcagagaattttacctgtatttccttctgcgcaagatacctcggcgtatgaagcagttccaccataaactcctgataatccgaaggttcaatccaggtggctccaatacgcacttcaatctccgatgcttccagatctctcggctgaactgcctccaatgcacggacattcggtgtgaattctggatgattctctgcaaaagttctcgctgtatttaatttatccctaacatttccggacagatattcatctccactttcccactggtctgtcagtggatttttgaagataactccaaccagctcttctgtgattttctcttcggtctttccggtcaactgtgccatatatgggagatctactttagccttttcatttagggacaaagcaagtgcttctgtggctgtctccacacttgtcacagcgaccgcctttttaatggttcgtttggtaaacatgtccgctttccgcttcaatgttccatcttcattcaagtcttccagggaacacagcagacaataagaagagtcatcagaaaatgcacgtttgttagcattacttccaataactccatactttgctgtgtaggtatcatacacctgattcagttttttctgctgtttctggatttcttcgtctgtgacaaattcttccatctgcatggcgatcagttcacgaacggtatcacggattgcaaccatgccttttacacgttctgcagtggctgcaggcattttcacctgattcatcaaagaattgacacggtaatatacctgatcatctaccaccgtatagctgtaatttcgaacattcggatctgccggaatactctctggcatctcatccagttctgcctctatatctactgccgctaccatgcttcccttgatgtgttttacagcttcttgtaactgtaattccagatcagctccttccattggagcacaggttgtttccataccatacggaccggacacttctttcatctcaccaagaatcaatcccggatgctgaacaaaatacttgttaatggtaatcccatttgcatcactctccaaattcacccagtctggcatctcttttgtgaaactctcacgcttctggaaaaacaaaatatcagcactgacttctgttcctgcatttgccttaaaagctgtgttcggcagtcggattgcccccagcaagtctgcacgctctgccaaatatttccggacttccggtgatgccttgtccatagttccctttgttgtgatcaacgcagctacaccacctggacgtaactgatctatagtcttggcaagaaagtaatcatgaatcataaaattgtagcggtcatactgacggtcattgaccttatatgcaccgaatggcacatttccgattgccacgtcaaagaaatcattgggataatccgtcttctcaaagcctttgatctggatattggcatctggatagagaagtttagcaattctgccactgatgctgtccagttccactccatagagtttggactggtttagattctctggaagctttccaaagaagttcccgactcccatagatggctccaggatatttccctttgtaaatcccagattctccaacacctgatacatactttcaatcacaatcggctgtgtataatgagcatttaatgtggaagctctggctgcagcatattcttccggtgtaaggacggtctttaattccagatattctgtctcccatgcagattttgtctcatcaaatgcatctgcaagacctccccagccaacgtacctggataagatttcctgttcttccggtgttgcattgcgattctcatcctcacatttctttaacaactggatagccatgatattggcacggaacttttcttttgctgtaccctgtccaagctcatcatctgtgatgcggaagttcgttgctggaatcgtttctgatattccgttaatctcttccaaagattctttttcttccgatacctcaacttctccagataattctttttcttttttatcataatctgtccacacacgttgagaaatagcagtaaaatacaaggactcttcctccataatttcttccctgatttcccgtaattcatctaaagtatccgcatttacagttttgttgtgataatgataataaagtacttcttgtccgagttttacatccagacgttccaattcttgtgttgacattcgattccaaatatcatctttttccgtatgaatcgtgaaaccttctccatcatcatgatattctaatgtgtattgaagtcgattcgcttctcccttaactttgcaatcaaaatcgtggatttttgttctggtaccagacatatattctgaatcaactaatcgcaaatcagttatatcttccgctgtcaaagtatcctgctccagctgttctcctaacatctgctgtgcttcttccaaatctgccagtctttgtgcttcctgtcgttcttcgtacttttccatttcttccggtgacaaataatcatctgtgcggattaactggcgaacacgttctgcaaccttgttccactttaataaaacttctacctctggactgccaattttcccttttgcaagttttaatccttttgcatcatgggatgcgtcggaagcatctgctcctggtattccgggtgaagaaccacctgttccatattcatttttcaggaactcagctgcatctttcatatcatggtgctccatgaaatactcatagattcggttacgtcctccggcagtaataccgcctcttcttaacactgcatcaatttcatcctgtgtgataaaggatagtgccggacgttcgaccgtaaatttctggtctacccaggaacgctccctctgaagatcctgaaagcgttggaaatattccggattatgctgaatctcccagcggtaataatctcccggattctcatccatatatttctgcagccattcaaaacgatagacaatcgcatctgcttcctcttgatctgtccatgctccactcactacatcctgccagtctgaatatgattgtttcttttcccagtttctgcaagtatcccgaaaatgaagtgcaagaagattggtcatttcttcctgctcctgttcaatggcattattggaaatcaaattatccacgtaatttccatcctcatacatatcccgaattctgttcgctgcttcttcccacgtaaccatgcggtcaaagtttcttctggcagagtcccctcgccggatacggataccatcattgtcataccagatactgattttctgaccatctatggtaaatcctttgccaccagttccatattcatctttcagaaaactccgcatttcttcattatccagaccttcaatcagtcttgctgtaatatgaaacagtgtatttttctgtccgcttcccgtgcggagaatatcatttaccacttcatcggaaataagaaaagcggctggctgttccaatgcagctgccgctttccttatttctcctaactgttcctcttctgttgggaacagacttaactgtaaataatctcctgaatcaccagctcctctgcctgtgccttgatctggttcatgtgtctggtccatgccatcccgtctgccattttgtccggtgccggatctttctccagaagttcgttcatcaggtcgtctactctctgtcttgcctggctgtcgatctccatcagatgactgtccagacggttctgcagtgtcagaatgttgaacctggctaccttgtgatttctcagatactctttccgcatcattccgtacttgccgatggttcctctcgtctcttccaggctgatatctggaatctgatactctccgttctggctgtaactgatctctctcatagtctgtttcctcctttttttcttctctatcttctgtgttatctgtattgctttcgcgaattaacgtgttaaattcattataagctacttctttttcttttgcaaccgttttcaggtcattttccagatcattcagaacatatcgtccaatctgcatcagaactggtctgctgatctcgttgactgcacttcccagatgtcctaatactttcagctgattgaagtccgtaatatgccgaaaatcctctgcatccagatattcctgtacatccagtccacacctgtttagtaatacataccagacactattggtcatcagttcccggaattctacttcctgattctgttcgtccagttcttccaaaaatgtccctgtcacatccagtctcagttcttccaatgcatctggaagccattcctgcatactctccttcgctgcctgatgcagactttcagcaagtcctccttctgtatcttccagtgataactgctcctgcagataatctgccaccagatgttctccttctactggaagattccataactgaggatcctttccaagattccgcactttataagtgtcctgcacatcaaatacataccgaagttttgttttcggtccggaagtattgtcaatcaaggcaatccccttagatccctttttgatccatcggtacatcttctgattccagatttccatggatgctacggcagttgcttccggtcgctgtgcataaattaaaagctgttctggaaaagtgtatttgtacagtctggatgcagtgtttaggaaccgcatccattcctgcggactggcagctacatcttttgccacctcttccgtcagctgttccattgcatataatttatttgccatgcgctactccttttcataaaatcagggactgcttagcacagtccccttaaaatcatcgttgcttctctttataatgctgtggcaagatcttttgacttattcttcggcactttctctgcttcttttgccttgatctctgccttggctttctccagctttccgtgtattcctcctttggcttctttttttacagctgttttttctgcttcttttgctttttctagccgtgcttccctgcgttcagcattttccatgactgctgtctttccatcacagaactgaaccttatctgacagctgttcctctctttctacctgtgtctcattgacttcttttaccatcgcatttagttccgggacctgaaaaattccgttatcagggagaatcagcacttcatgaatggaagatgggatgacaaaataatcactacccaggcattccccaatctgtttacgaatatcttcctgcagtaacagggaagctccattcatcttagctttgtttgtcagacagaacattgggttttccatggcttccatatccattttttcattcagcaggttttctggttcttcaccaaaaatcgtagatttgataatctcattcatatccataagtgtgacaccacgttttcggtctgccaccatcgcatccgcttgaatctgttcggcagatactccccactcgttcatcagagaaacagttaccggaatactgctgatcccttctccattttcctccagatttactgcataataagctgcaaaatctccgtgttctgtgactactttatctgcaagaagatcggtattccattccttatcacaaattctcatctgtaatttgtccttcatcttttcataatccagaatatctggaactcccatatcaaaaaattctgcttttccctgtgcctcaatacgcatatcagccacatcgccaacacaagagtctacatcttttccatggatatattcctggtagagagaatccagatagactgtcggtacgattctctgatctccattcggaatcgtaatacctgtcagcttcaaaccattgtttttttctacttcctgaagtttaatttctgcgtccttataagactctggcagatactcctttacattgtctttgacatattcataaaattcttttctgttcatcatacgcttttacccctttctgatcatgtgatggttcattctttttctgttgaccatctgctcggatttcttctgataagccatcattctctttaaagttttctcctggttttttcgtgcttcctgtcttttttccattgctttcatcatagttttctgttcctttctgtgatatttttgtatgaaaaagggagcctcacatagaagctcccaatcataaccgttggttttagtttccttatttccttttcctgctgatatacagtcctgccatacctcctgtggagattacaagaagcaggatcggcagccagatattcgtgctgtcacctgttttcggtgcgtttgatacctttgtctcttcatgggattgtggtgtgttcggtgtttctggaacttccggtttctcatttgtcagattaaaggtaacttctacaaccggtgtactgtcatctgcataggcaaatgtcacttcatgcttggtctgatccagtgtgtatccgtccagtgtctttgtttccaccagataatacttgatagcggtatcatatttgccgttcttaaatgtggcaatctcatacagcttactttctgcatgaccggcagcatctgtctttaaggtttccagaacttttcctttgctgtcacgaagttcaaattctacccctttcagcggttctcctgatgatttatctgtcttattgagaatcacttttcccttggcagtgtcatctttcatagctactttctggatctttccagtatcctttacttcaaaactaacatccgatgtcagaagatatcctttcggtgcctgctcttcacgtaaggtatatttaccgattggaagtttttcgatatagtgtgcttcctctgtggaagtccagctctctactacctgatcatcctcatcgagaatcgtcagtttcgcacctggaatctcagtttctcctgtgatatcagtcttactgatctctacttttgtcacatcatctttcatctcatgcttctgaacctctgctgtattctctactgtgaaagtaatactttctgcagtgacatatccatctgccggttttgtctctgtcatggtgtatttcttaccaacaaccagttctttgatcacatgggattcttccgtagaagtccattcatctactgtattgccatctgaatccgttactttcaggtgtgcacctggaagttctttacctgttgtcaggtctgttttggacagctccactgtggttggctgattttcaaaagtaaagtcgtagcttacttctgcctggtcttctccggcatattcaaaggtaaattcctgtacttcttctgttgtaacaaatccgtccggcgcaaagatttctttcacatagtattttccgtctaccggaagatctgccgtaaaagtaatctgtcctttttcatccgttacccgctgctcgatcagactgtctttctcaaggagtacctcgccctttgcatttttgatatcttcactggtataaagaccaaagacaccacctgcaagaacacgttctgtatctttttctttcttcagaaccgtaacctttactttctgacgggcattctgccatttctcatcataagtgatgactggtgtgtcctgatcacggtaggaaaggtcaacatatctcggctctttgtccagcacataaccgtgagctgtttttacttccttcacatagtattttccagccgggagatctcccatctgtgcaataccattggaatctgtggtaatggttcctactttttcatctgctttgaaataatcttcactgacaccatctgccgctttgatatcttccgcagcaaatacatcgaaagccacatctgaaaggcttccggttacatactcaaaaagatgctccacggtaccttttacatgatccaaaagtgtcaccttatccagaaactctccatttttgttgatgatcagaagtcctgttggaacttcatctttcatctctactttctgaatctcggcagtatcttccagtgtgaacttcacatccgtcgctttcagatatccatacggtgcaatttcctctcgaagggtgtattctttacccacagtcagtcgtttgatcacatgtggctgatcttttacagaagtccactgatccacaacatttccttctttatcaagaacggtgagttttgccccatccagttccacacctgttgttacatcagattttgtgatttcaactgttgtcggctggttctttttcactgttttcagttttactgtcttcacatcctgcccctggtaagaagcatccagattcagaacttcatcagaggatacaaatcccgccggtgcttttaactctttcacataatactgtccaagcggcagatccagcgtacatgctgcaagaccatcgttatcagaagtcatttcctgcagaagtgtatctgcctttacaatgatctcacctttctcattcttcagatcttctgtgttatagatgccaaagacagctcctgctacgggtgcaccattttctgcatcctgtttttctacctggattgcaactttctggcggtcatcgccaaccatcacttcctgttcgatcacaggtgtatcctgatccgcatagacaaatgagacatccgatctgtcatggttcaggacgaatccttccggtgcagtcttttctaccacatagtaagaaccaagcggcaggttatcagcaactgcttttccgtcttccccggtcgttaccgttgttaccagtgcatcttttgcatagatcagctgtctgtttccgttttcatctttctgataatccggtgtatagatattttcagctgcatagacatgaaatgatgcacccttcaggtatctttcttcataaacaaaatcctttttaaatccggtcagcatctcaccttttttatagatcgtcagctttccttttaccggatggttctcgtagtctaccgtaataatggcatctccgctctcagaatccatctggtatgctgtatttgcatccaccgcaatctctacatagttcttattgattgtgtacccttccggtgcgttgacttcctcaatccggtaatgtccgatcttcagattcttcggcatgatcagatatccctggctgtccgtaaaataggacttgtgagtagttgtcactgggtaagttgttacctgctccacatacttcttgttgtccaggtcatataccttaaattctgttccggcaatcaatacagatttctttgtttcatcgtcttttttcacgattttcagttttgccttaaactcttcatccagaagcactcgccagatctgtggctcgtttggatgatgttctgtgatattcacttcaaaatcatcgactggcttgtaattgtgcggtgttgtagtttcacgcacgatatagcttccaaatggtaatggaatactgcaggcataccctttttcatctgtgaaaatctcagttgctccattttctctactcactactggtttggcagaatcaaaatcatagcttccatctgctttctttgtaagggaagatttcagataaactgtaaatccggctccggataacagatctgcatcggtctttccattgttggctgctttgatgatctgaaatggctgtttgatgacctgctcactggaagtgcactctctttttacttctgctgtcatatctccttcataactgcacacaagatcatgctcttctgtatctgccaggtatccggtcggcggtgtgatctctttgacataatatttgccaagatataaaccttttacagaagactgtcctttgtcatctgttgtaagagatgctacctgttctcctgctttataaatagttccagttgctccgtccggatgcacgatatcttcacgggcatacagaccataaactgcacctttcagtgtggcatctccctgtggtactgcttttcctgtttctttatcaactttgaataaattgatctttgctgtcacacggtcattgctgaaggtatgggcaaataatacggttgcttctttatcattggtgtaagaaaacttgaacgtatacacatcttctgtatttcttacatagccttccggcgcctgatcttcttttacggaataggaatatccaatcggaagatctgctgtgaattttgcagttccatctgctccagtagttgctttctcaatcagtgttccttttttcacaacaacggttccgtctgcatttttaatatcatcggatgcatacagagcaaaaataccgccattcagtggtttctttgtatctttatcctgttttactacggaaacatctgctttctgtctttcgttgttaaaagtcacatctgcaaatacaacttctttattctgtccggcataagtcagagtcactggcttttcttcgctgccgttatagaaattgtccggtgcttttgcttctttcaccacatagcttccaagatgcaggttcttcagtgtaacagaaccattctctcccgtagtcagattatcttttaccaggtcacctttgctgtacacttttgtgccataagcagttacgatatctgccccggcatacacgttatacactgcatttttctgtctgcggttttcatactggaataccgttccattttcactgacatctgctccggtaagaacctgtccttctttgtaaatggtaagctctgccagctgttccttattttccacagttaccgatgaggttttacttgctaccagttttacatttgttgccgttgcatttaccacatatccctgtggtgcggtgatctctttcagataaacagtatcctgtgtcttgatgatcgtaacagaagattttccattcttatctgttgccggcatctgaatgatcagctttgtacaagcctcatcgctgtatacaccgaacactgcacctgcaagattaacatccgctgtatcgtctttctttacgatttcgatcgtagcctgttcaatccaggacacctttaagcttacatatttttcatcagcgacaccttctccaaacacaaatgccagatcctgaacacttgcattcgtagtcagtttatatgctgaataatcttttgtaatacttcccttcatttttgcagaaaaagtagcacttacatctcttgtctgtgtcagaggagctgaaagataaaacgtggttccgcctccaattgttacgcttgcacctgccgcacttacatttccagtagatacattataaagcttcactccctttggtaagtccattgtgattttctgctgggaagatgcattgaacttaatgttctccgttctctgaacatttccatctacataagcttttacattcggtttggaaaatgacatcgctacatctggtatttccggcttatttgcacaataattatagagttcttttgccaaagcctcgcctgtagcatttgttccatagaatgcatcactgcttccattggcataagatgcagccatgtgaataatgatgaatctttttccttctgaaaaatccgtgtgtttattcgcaaaaaaactttcgcttcctgcggcatctgtaccgtaataacacacttttgctaacgcctgattgtccccgatctttgtgattgtataatttccagatcctggtcctggttttgccggctgtacacaatacgcagttgctctgacgcttccgtagctgatatagtacggctctgtcagataggttccaagattataatctgcatatctatacagaggtcctttttcgattgttacctgctgtgtacttcttgctgaataagccgaaactgcttcaaatgttgcaatctctccctcttccatagaatcaagatccacaccttcgtctcctgcctgttccaaaacatcgtgaagctctaacccggattcttcatcataggtatcctgattctgtgcctgctctactaaatcatcaaattcatcagcatcaatatcggtaatttccgagtctgattctgaatcctccgcttcttctgtctgctgttcactgccagctgtttcagattcggttactgcttcactccctgcagtttctgtctgcacttctgtttctttctcacgcacaatcagctttcggctgatctgatacttcggatgctcctgatttaccggttccacataatagaccgctttgtaagtgtccacatgatctgtcgtaaaatcctcattcttgtcgttctttgcttcctcaaatgtgactttaaccttgtcagcatccttgatttccagtcctgtgtagtctgatttcacatcaaatacactgcctgtttcaagttcataatctttggcagtcaccacctcctcttcatccagaaggtctttcacttcctcataaagtggcggtttttcctctggctggatctccgctgcatatgcagtcatcggagataacactgtactaagcattgtcatgcctgccagcaatccagatactactttcctaaaattaccttttttcttcatgctaaggtcctctctttcataatatttgtatgaaaacagacagtccttagactgcctgcaatacattacttatcgttgtgggaaaatcagattgaactgcacatttccctcgccgggatcaatcatttccacagttgcttcatactgtctccctgtttttctggataccagatccttataatggatttttcctttagacaggaacttctttgctgccgccttatccatctttttcccctggcttgcaaggaatttatcattcttccataaggtaaaagcacagttccggtcggaacagtaaaagtttacttttccttccctgacatcagctccacatcggggacatttgccaatgacttccccttttgcttttccctgaaactgctctttcttttcttctgaaatagcctgatatctggcaaccagttcctgcatcagctctgtaatcccatttaggaattcatctgctgtctctgtattctgggcaatgtgattcaatgccatttcccactctgctgtcatcttcggagatttaatctcatccggcaaaaccgtaatcagtacattgccatcatctgtcggcaccagatttttcttttcccttttcacaaaaccagactgaatcagtttttcaatgattgctgcccttgttgccggagtaccaagtcctttcttttccgtatcttcggtcagttcttcattcccagcacgttccatcgcagaaagcagggtatcttctgtgtactgtttcggtggctgtgtaaaatgttccgatacaaaagaatcacaaggaccgtaatgcttacctgcccagatatccagctccggctcttctttctcactctttacgccaaagaactgtttcattttattttcgattgccttgaatccttcctgctttgttttctttgccgtgagataaaacgtatgataattacaggtaatctggcttttatggctttcataaatataaggatctgcagttgctgtcagtaccctggcactgatcagatacaaaatcttgcggtttcgctctttcagtttacctatatctgcctttgctacttccatggtcgggataattgcatggtgatcagatactttctttgaatttaataccttactcacgtccggttgatattccaggctttcagcataaggcatttccccaagtaacatctgaatcagagtttctgtgctttctcccatctcatctgtcagatactggctgtctgttctcggataagtgacaagcttctgctcatacatctcctgcactgcatccaatgtctgctgtgcggtatagccaaacattctgttagcttccctctgaagggtggtcagatcataaagcttcggagggcggactgttttctctttcacatcatccttttccacttcgcacatccgctccaggcagtccgcagccactttatctgcatcctcttttttctgaaaatgctctgtaactgcatccatatcatcaaacttgatatgagccatataatatttttctttggtaaattccttaatcttctgatttcgatccacgatcatggcaagtgttggtgtctgcactcttccgactttcagattctggttatacagaacggaaaaaagacggctcgcattgattcccaccagccagtctgcctttgccctgcaaagtgctgactgatagagactgtcataacacgaaccgtcttttaatgacgcaaatccatctttaattgcctgttcttccatggaagaaatccagagccgcttcatcggctttttgcatcctgcctgctcatacaccagacgaaagattaactctccttcacgtcctgcatcagtagcacagatcacttcatctacattggaatctctcatcagttttttcaagattccgtactgcttctttgttccatccaaaaccttgtgtctccagcattccggcacaatcggcagatcttcatatctccattttttatatttttcatcgtattccgatgcatcgcataatccaactagatgtcctacgcaccaggaaacgatataaccgtttccctccacgtagccatcttttcttgttctggctcccagtaccgaagccagtgccatcgcaaccgatggcttttctgcaatcactaatttcatttactcctgctcctcttcttcatcttccagcacattatcgtcaaaatcttcatctctcaggatttccggttctgtactttcttcctgctcatctgcatcatctacttcccgtttttctgactctgaatcttcggattcatcttcatcctcttccatctcatcctcgtcatcatattcatgttttggtttatagactttgaagtaatatcctcctgccgcagctccgactgcaaccagtgcaatcaaaagatacgttccaaatggacttttatcttcaggcatctgaatatcatcctctaccttatctttctcatctgtctctgtcgtttccggtttttcttcctctgcttttttctctggttctgcataaaccgtatccacttccggaagtgtcaccgaatcagaaagtgtgaagttcatcagatctttttcactgacttctgtaagaaaatacacattatcctgagattttgaattgtcaataatcagatagaaaatcttaccactcttagttgaaatggtataaaactcttttgtgccttccgtagctgttttagtaacagaatctgctgtctcgccttctttattaagctgttcctcaatacctgtcactgtccgatcatccacggttccttttgcatctgtcggctcagaagcctgtgcatcctgcggaagcggtgaagtcgttgttttctcagtcccagttgcatctgcactggtcgtggttgccattgcaccattactgtcaatggaagttttctgtttctctgcctgcttctttgcccattcataataaggattctgtaacacatacttttcagacgtatttccggcaccgtctgttaccgtaatctcaatctgttttgtagtaaaatctttctgtgtcaattgcactctcagcattccatccttcaagtctgtataagtggtgccattgactgttactgcagtaatccctgatactgtatcattcccctgaatcgtcagcacaccatctgtcagggaagcagagagtgtaggcttttccgtgtcataacacttaatagagcgattctgctcatagaccttcccctcaccatctgtcacacgcacatacactgtctggtttccagtgatcgtgatacttccacttccggttacatcctgccagcttccatcttttcctgcttttgcttcaatctttgctattgagaaaccttccggcatatgactggaatctaccgtaacagcaatggttgtttctccctgtttccagccatccggtttctcaatcgtgattgcaggcgtggtattctcagctgcataagcagtctgtgtctggagcaaaggtgttgtcaggcaaagaaatgtcgttgctgcaagcaagctcttttttaccctgcttttagtaattgttctcttcttctgtttcattttttccagattcatcatcggcttttgtttcctccttctgtatttctaccctgccgggcagttcatttttcattctctttttgaaagcttccaattctggaatactcatatccattgcacggataattcttacaatttccagattttccgcttctgttttggcaatctccgcagccttgaaacgctttaaatctgcttcatatctggctttggaggcttccattttctctttggctttctcataatccgccgttgctttttcaagacttttcatcgcttctcctttccggacggctgatacagccgcccttttttcttaccatcgtccgaatccatagaaatggctctgccagtatggggaattgatggacgtatactgcaccggatgtccacaatggatcatctgaccattgcctacatagattccgatatgcgttaccggctcccctgcgtcgtaagttccagtaaagaagatcaaatctcccggctgtgcctccgactgggatactggtgtacaaatgttgtacagtccctgtgctgttagtcttcctgtattccttacaccagagtttgtcagacagtagcttacaaatccggaacaatcgaatccacttggggaatatccaccccacacatacggtgttccgagatatctcgctgcttcatttaacaaacgctgtgctgcttcactggtatattcattgccgccaaagcctgctccttctccagtttccagataaaagatcgggtttaaccgctctccatttttcagaagttcaatatgaagatggcttcctgtggaatttccagtatttcctacaagacctatctcatcacctttcgtgacggatgctcctgcagatacactccggctgcttaaatgtgcataccgtagttcatagcctttactgtccttgattacaacataattgccatagctgtcgttataagcagaagttgtaactgttcctgtcagtcctgccatcacttttgttccttccggtgccccgatatccatgccattgtgtaactgattagctccagaaatcgggtgaatcctgtatccataatagctggtcacactggaataccagttaaaatcaaccggtgtcgcaaacatctgcaagttgccttttgtatcgttgtaggcactgaacagttctttctggaaaaatcccagcctgtcctgacagatcgacatcagatttccgctgtttaaggtgacattcagcacatctacatctcttgtcctggtcacttccacttcctggcttccattatcatctgccagatagcattcccaggtcttatgaccatgtgcggatgctgccgcatgactgtcataatagacatcaaactgtacaccgtatcttgcgaaagctccggtatcttctaccgtatattcgacaccattcatgaccacctttgttcccattggaacaaacggattggaagcatctactgctaaggtatgattggctgttggatatgctccactggcagtcggtcctccactccaaataccacaacagattggacagttacaatatccgcttgttacaacctgtcccaacgattctccaactcttactgttgctgtctctgtcacagtttcattgactgcttcagtagtcagatgatattgctctgcaaacaatgcatccagttcaggcttgacctgttcaaaagtaaactcctcatactttgctgacagataactgattaggataaacggatcatgctcaataggtccgatgttatatcggtattcctcatgtcccggttcttcagactccatgttgttaatccgctcctgcagattagcttccaactgtgtataatacagttccgcttcccggattgcctgatccgatgacagataactggttcccgtgtaagtgatcacattttgtaaaaatactgcagagcatgacgtgacattcgttataatcagaaacatcaatccgatcagaactgccacactgatatacaccttccggttttctttaaagaagttggtgactttgccgccaatcttcttgatataatcaatcgtaccttttgtagctgttcctactgtctgttcacttcgttttgctttggcataatcccgtttgatctgttgcttctgaatctgtttttttagcttcttctgctcctgacgggctgccgcctgtgtctgtttctctgcctgtctctccagtctgcttctctttctggaagccctctgtttcctttgtctggcacttctctgttccagccggtaaataccttcgcagccttcttccaacttatgggcaccttctactgccgcattatcgtcttcatttttactgatctcacggtgcaatgctgcggaagttgcacttcctgctttcttaacaacaaaagctttttctgttttcacagattccccttcgccaaacttcaggcgggatttcttctttccagaaccctctccttcatttgcctgataaacctgtgccttcttggaatgctgctttgcttcctttttctttcttggttcctcataagaaaactttttggctttttccttctgtttctgatgacggaaattgactccatccgtatccatctggttcaatttctccatgtctttgtcatttttcacagaagcaccagtctcttcataagcaaatttcagacgctgtttctgctttggtttcttacttccaccattcttcttactccggctgtctcctctgttttctgaaagatccgcacgtttttctttcagtctccctgactggctggcttcggatttttccgcaaatcttgattcttttctgttcacagcacggattcttttccggttttgttgctttctattttgtccaaaatcctcactttggttctccgttcgcatcagttccggtgcatccctggatttttgcacagagggacggatatttttcccacttcgcttagactggcggggagacttatccacaaggttttctgctttttccccctgttttattcccatctgcacatcactgacacggttactgacacgaacagaagatttatccgtcaggttttcttccaccagaccatctttggtcatcttctggactttcttatccctgactttcattctctgttctgccactacttactcctcctttttcggataccctttccctgcctgtaataaacagagaaaagcgatgccaaatacagcaccgccactaaaagttaatacatatgaaattgctcgtaacattgtcttctcctttgatttaacctgcttcggaagtttcctctaagcgggttgtcatgattttatagagggaattcttcgggaatctgtctacgaacgggataatgacatttccatagaacagaagtccttccccctcattactgttggttacataggacagctgggttggtgagatattcagctgttttgcaagaatctgcctgtctccggaagcctggttcagcatataaataaaatctgaattttcaaatatattctctatttccctggaagacaataaatccttaatattctgggtgatgcccgttgggataccaccccatttacggaatcgcttccaaatctccacgctgtaggctgcagtctgctcttccttcaaaagaagatggaactcatccacatagtatctggtggacttatgggcagaacggttcatcgttaccctgttccagacctgatcctggattacgagcatcccaatctttttcagctgttttcccaattctttgatgtcaaagcagacaatgcggttattgatatccacgtttgtctgatggttaaatacattcaaagagcctgtaacatagatctctaatgaagtagccagccgctgtgcttccggctcttcctgttttctcagaaggttgtataagtcctccaggattggcatcttctccggtattggatcggcaaggtattcctgatatactaaccgcacacaacggtcaataatcgttttttctaccggttccaatccattctttcctccaacaatcagctcacacaaagacaggataaaatctgctttcaatgacagcggattatcttcctcagaataattcaggttcagatccattggattgatatactggtcagataccggcgaaactcttaccacctgcccatgcagcgcctgcacaagtgccgaatattcggcttctggatcacagacaatgatatcgtcctccgtaatcaaaaagcagtttgtaatttccctctttgctgagaaggacttaccggaacctggtgtaccaagaatcagtccattcgggttcttcagacgtttccgatcaaccatgatcatgttgttggataatgcattcaatccataataaagagcttccccttcctgaaacagttcctgtgtcgtaaatggcacgaagatcgctgttgaagatgtggtaagccctctctgaatttcaattcgattgactccaagcggaatacaggacatgagtgctgcttcctgctgataatccagctgttttaaggaacagttatatttctgtgcgatcccctgcacctggaaaatattattatccagcttctgacgcttctttgcggtattcattaccagaactgtcacaaggaacattctctcatttctggactgcagatcttccagcagattctttgcctcttcgccataagtcacaaggtccgatggaagcacgtccatatcataaccggaacgtaccgcacgcttctgctcttcgatcttcatcttatcaagatcagaaatcttactcttgatcatcttgattgctgaactctgatcaatggactggatatgaatgttgacattgatgctgtcatccacatccagaaaatctgcaagcatccggtctgtcagctccggtgcaagaatctgaaggtaactcacacttcccatcgttcttcccatcaaaaatgtctgattcttggaaaagttaaaggaagtcggtgcaataaaatctttggtctttaatccggtttccggaagcatcttgtactggaacttaaatggttcaatccgatcctggttgaacacatgatacagaatctccagcctttccagtccattcaaagaatgtgcctgtgctcccagaaccttaaagttatttaagatatctgtttcgattctttcaagccttggtcttgctaccttcagactttctgcttcaattccaaaagtgatatacttcgtctttaccagaccattatttcctttggaaagctgatttttcagcatagtacggtattcttcacgaatggcattgaagtcatcgttctgatccggaatatcaatacttttctcaaattctgccacatccacctgctgattgataaaggacagctgcacactgatggaagaatcaaagtaatttaagaaatcacagtaattctcaaatatcgtggtcttatcctcatttaaagccagctgataattgatgtcataaaactgaatcgtcttagagaaaaaggtctttgtcacctggcagataccatcctgcagcatccgaatatacggaatgctctgctgtgcagttgtaggaatgcctttctgtttcctgcgattccgttcctgtttcttcttacgcttttcctgttctctttcttttctgctttttttgtttcttctttcctgacggtttcttttttccgccagagacagacgctcctgctgagcctcctgctttgtcttttttgccatccggcacaccctccttttttacaagggtggaaatctcctgataaaaattttctgtcttatatggtcttaccgctggacagataaacttctgtcgaatgatatttgccaccactttttcaaagggaagcccgtctttttcatacatcgccatgaagaaaaatggaagcatgatcgttaccatcagaatggcagcaatactggaaccgattggttttctcatgaacagataaaacggaatccccacaactgcggcaagtgaaaagaaaatcagctgccgctttgtcagatttaacgctacttttgttttgaccttggtaaggtcttttggtactggtacatacgccatggtatgcgctcctttcctgcccgttaatgggcattgaatattgatttgctaaggcttccggtcttgaataatgaaaatgcaagaatcacggtataagccgctactgaaaacattgctgcatgaaggtcactggatatggtcattgcatttactaaaactgcataaattcccacacagaccatcatgaagaatccctgaaatgccagtgcgaacaagccttttaaatagttgtttccgatattgccccattccttattggtcatggtggcaaacggaattggtgctatggaagtataaaggtaaatttctatcattcttccgtacaaaataacggttatgatgattgacagaatccgcatggtaatactgatcagcagcgtttccatggatagcaggaacaaatcccctaactccatatcctccagggcatccacaatccgtgtaattgcttctgttgcatccaccgcagtgtttcctgatatcaccccggcggcattgttgaccacatgttggccaacgtcaaagaccgccatcgtgatattgaacgtatttgtcaccagataaatggccacatacgctttgaagatccagaggaaaatgttataagtctcaaattcatggaaattgtttttctgtgttaccatcgtgatcaattcatagcacaggacaaaggtgatgatcagtcccgcaatggggacgatcaccgtttgggatatattctgaatcagattaaaaatccctgcattccatccctgcggtgtctgtcccacctgcccggctatggttcccacctgctcattgacagacgtgaacatgttatccaaacatgacttgataagtccgatcaggatatcctttatcgcttccgtaattctctcaatgatggtgttcatctaccactcctcttaagagaacaatgttgccagctgtggaatcagggtagttcccagcagcatgattccggcaccagccatcagctgtttgatgccctggctcttagcgccgggattgtcatttccatatccttccagaaggtttacgacaccccacacaccaagacctgcgccgatagcgactacaagagtttttaaagttgtaattgcgctgctaaaaaatgccatatattcataaaccaaaactgacttctttcaggtgtttacgggaatgaaaaaacaccgactaaaaagccggcgcacctaatgtcagttattcctttcctcattatttttcgttcattcccaaggttactccgacagttctacatgaatcacttccacctcttcttcgggtttcggtgtgtactgcggatttaactctttctctactttgtaccggttcttctcgttttcatctgcaagaagccgatagtttttgtgtttcgtgatatcatatttatccgagaaaaatggtctggcaccacggatctgcaggatacattttcctccatccatgactgcaatctcatcttccgtcatcagctgtttgcccgttttctggtaattcaatccaaaagacttctgattactcctcgtttccgaagtgttatacaggtcaatggtttccttccccagaagctcactcatttcctttaaggtggttttctctttgccaccaagaaaaagtgtagtatcacagttgcccagaatggtatctgcactatccttatacattgcctttaactgactctgcgactgcaaaataatagaagcagagatttccctgcttcgaatggttgcaatcagcttgtcaaactgaggaatctgtccgatgttggcaaactcatcagcgatgacacgcacatgcaccggaagtcttccaccatattcatcatctgccttatcgcaaagcagattaaaaagctgtgactgtaacatggcaatcacaaagttgaatgtggtatccgtatcggacatgatcagaaacaaggctgttttcctgtcaccgatcttatccagttccatttcatcgtaagacatgatctcacgaagttctgcgatatcaaatggggcaagtctggctccacaggatatcaaaatacttttcgctgtctttccagccgccattttgtattttttatactgtctgaccgcaaagtgctgcggatctctttcttccagttcctggaacatcatatccacaggattctggtaagtttcatcctcttcacgcgtttcgctttcattcaaaagatccagaagggtattcagattcttttcctcttcatccccttcataccagataaaagcaatcagtgctgtgtacagcaatttctctgcttatagtgataggtaaggttttgatattatctccaccttttcccccacttcacaccggacatgcgactttcaccgcatccggcgctccatcgattgtcttcacgagacatttaatcagtcaccaaatttaagttttatattattgctgacaggttcgcctgctctcgcagactattgattttcacgagcatcttttttgtgatattgagtgtttttatcaggtcttttattactgcttggggcagttcttttaacagaatcagatattttttgtgaatcagaaccatgtttttatatctttcaaatccaccaagtgctcttggtattttgagccatacagctacatgttccgcatctgcgaattcttctccactgattgcacattttcccttttgagcagaaaataaagatattttactgtcatggtattctgtgctatgaccaacggatattttttctctcagtcctttcagaacatactgattaaggttaagttctgtatgaatcggagcacgaccttcttttgtataactacaaacgattgatcgtttcgccatcggtattttatttttgatgaatgcaatcggatagatcatctggtcaattcctgaaacatatcgaatcatttttgactgtccgaatctttccttttctgcttgggtgatagttccaccctcacgttttagcatacttcctgtttctgtatttaacctgttcgtcaaaactgtcattactcgcctatggaattctctgcaatcaatactgatacaggtggcaagctgatagtaattctgtatgcctaacaccatagagttatatagctgaatttctgataaacaactttttttctctcggggttttgcgatgtttttcgcttgttccactagctttgctctttcaatttcaacctttttgtcacagattgccgactgcaccacatatttatgatgcttcaaccttacccttattttgagtccaagaaactctgaccaccgttttctggtgttcacaatccttgttttctcaggggacacctctaatttcaacctctcttcaatccacgccgtaaccgcttcttttgtcctgactgcgtcctctttcgttctacagaaaatcctaaaatcatccgcataccgaatgatatgcatttctttcatttctgtgtttttcataatcctataaccctggcttttatcaaaaaccttagtttttccgattattctttctcgccctctgcttatagcaatcggattttcctcccattgactagctatccaccaatccaattcatttagaacgatgtttgccagtagtggtgagataattcctccctgtggtgtacccttgttgggcagtaccgttgtattatcgggcattttaattggagctgttagtattcgcttgataataaaaatcagcgttttatcatggatacccagcgaccatatctgtctgattaacttgctatgatttacgttatcgaaaaatcctttaatgtcaaactcaataacataatgcaggttcatcatttgaagcatggtgtaggttctgttaatggcatgttcaacggatctattcggacgaaatccataactattattgctgaactttgcttcgcagattggttccatgatctgcttgatacattgctgtatcaacctatcccatatgcatgggattcccagcggacgtgtttttccgtttggtttcgggatatctttccgtcttacaggctttggtctgtagccgtgtttgcttcccgtgacaataaatctcactctttttaccacatcatcaggagttcgactcccaatgtctgtgatgttctttttgtctgttcctgccgtgtagctgcctttgttcgctttgatgtttcggtatgcaagtaaaatgttatccctgctcagtatcaaatccataagattctcaaatacttcaccgttctgacttttttgatataattcgtcaaaagtaccttgcattccgtagtactccgcatgacgcaggtcatctacacataatgttttacttttctttggcataaggcatcacctcctctcgaaagtgacccttttggtcttactcgtaatccttatcataggactgaataatgcctgtttatttcaaccgacttgtgaccattcctccgagttcctctttttcgcagaactcctcataagttcgatcacggcttttcagcaccagttcgcctgcttattttcttcgtcaggctatcccataatggaatctgatgcctttccacgttccgataatcctatctgtacatatatccttaggtctctgctatagtcctgtcagcttggatgtgcctgtaacacaacatggtcgttcgtagggtcaatttctactgaaccacactgactgcgctttaacgcacccatacatttctatatggtcttcttttagaaccgtacattcgcagttttcgtcagtttactcgccaaagtaaacattctaaccatagatattttatagatcctagacctataggtagcgcaccccacctctggggcgttttcgagaatctttttgcagattcctacgactactctcggtcgttgtcacggagcttctcaccccagccattacagctgacgcaagtccgtcaaggatagacgtttcagggcgttaccccatcattccacctatcggattaccagttcacagactggttattagttaataaaccaacactgtgcgcagactttttaccgcctgcgaacgtgtcgcactcacccaaaaatcttcggaagctttttccccttcgcctttggtattcacaatgattgttgtcaccagcttcaggatatctttttcagaccgtatataagcaaatggattgtaatgaagcgattttgaaaagttaatggtattcaaaaccttaatcacatatggctcatgaaccacttttccggatttatctttcatgatatttccattcttatctttcttaggcggtccctttgctaacatcttcccgcactcctcaatgagagtgccctttggatctgtaatgaccatggaacagttcatctgcatgaccgacggctttacaaaaaatcgtgtctttccggaaccactgccaccgatgaccacgatatttttatttctcgcatacttcggctgctttggtctgctctccatggtcagtgcttctgttgctgtcaatggaatgttcatccatggatcttctgacatataaggcttgatatcctctgcatttccccatctggctgaaccatactcgattcctttccggagtttctttgcatctgcctgtttctgccagaccaacactttcagaacgactgcaacaacaatacctgctagcagatctttccagttattgcttaacacaaaaccagcaaaaatccggtctgcgtgttccattgcatataatagtttgttccccatatcttctcccggactgttccggtaaagaaaaaatgcccggtctgcatagaaagcagccagagcataaggaatatttgtaagaaccagtttctttttatccagggcggacagcctgaccctgatcttattcttccatttttgcatcagatttttaccgatttgctttttcatcggctctgctcctgatgccggttctttactttgtccttcgatttctttggcatcattgcccggtaagctgcaagacgcttatgaatagaaggcttattcgctttttgaatctgtttctgggaaaactcacggaaagcagcattgagggcatcctgatcacgtcccttgaaaaataccagataaaccggcggctctttgctcttgtcttttttcagagcataattgatcccgtattttctggcatagcgttcaaaggacttgatattcttatttgtgatctcgatattgaccatcccggcattctgttttgccagctcttttaccgtgacctttccctgtttcggctgatttttctgtgctttcttctctactgatttctgcctctgatgacgcagatacgcaacaagaacctttttcaacaggtctgccgtaatcttagtagcccgaatacagaacgtgaccgttttctgagttacctcttcctgcatgacttttccctcctttcagcgattcaactgctgtccagatctgtaatcatggcaaccaccccctttaatgaaaaaagacagattaaccggtaatcaggttctgcacctgtacgagtttttctgtcccttcttcttttctcttatcttctccaccacaatagatgggaacacacatttcaagtattctactgtaaatacgctgatgggcagtatccaagtctgtggatttcatttcattcagtcccagattcgttgttacgatcagcggaagcattttacaatagcggctgtctatcacattatagacctgctccaaagcaaactcagaatttcgttctattcctaaatcatcaataatcagcagcggataatccacaagattttgtataatctggttcttatctgcctgatagctggtcatttcatttaaaatcctggaaaaattcgtcatcatgacacgttctccctgttccaaaagtgcatttgcaatacagcctgcaaagaaacttttcccagttccaactggtcccatcaaaagcaatcctacattttttctcttcatatctgtccagttttctacatactgcctggcaattagtgtcttctggttgcttccattgtcattttcaaatttccattcccagaatcttctttcccgaagtccgacggattttctctgataaagcagccgctgtgcttcttcccgctgcatcttctcatccagttcctgtctggctttcacctcgcattcgcacaaacaggatactacatgctcaaatcccatcagactgactttcatctgttttctttttccacagatgccacaatgaagacatccctctttgtccagataatctgctgttactttattttccatcacaggctttctccttcctgaaattcatatttatccattcctgccctggctccatcccgttctgcccaaagacagattgttgcaaaatggttctgatattcttttccactggatttcatataaacagaaagatgatcaattcgtttctggtaatcccatggaaaaagcatcatcaactcccgcagttcagcttccgacagaacaacatttttaaatctcccatacagactgaatttttcttccaaagcggaagtattgcccttactcttatcagtatgattcttttcagtcttatttatcttagtattatttccatccagattcttgcagtccggacttctatttttttgcgttccggacttccagtttcttgcaatccggatttccaattctttgcagtctggatttccagtttctggcgttccagaagcaacgtatcttactggctttcctctgatccgtttcacaaaatttttcacatatatgacagaaggacgattattcccctgccgataccgttcgatcaatccaatcccatgcacactgtcaagctcataaagaagctttgtcactgtcgtatgcgacattcgcaacagctcctgcaattctgcgatcgtgtaaataatatagacataaccatcaccgtcaatccaaccatttttcttggataggctgattcgatcaagcagaattccgtaaaggagctttgcgtctgtggacaggcttgcaaactctttttctgtgaacagagcttttggtatccgaaaaaaagaaaactggtcagattcttctgctctgaaatattcaaaatctgccataatattttcctactcttctacatcgaaatcacaatttgccgcactacctgtaccatgacataattcatcaagcacataattgaatgcattcatcgcctcttccaaatagattttcctagcctctttatcacacgcatacatatcggcaataaatccttcatcatttcctattgcgtgtaccagagtctccaaaactttcataaatttcttttttgaacactttttattctgcctgttcacatatttctgaatatccagtactctatcagcattttcctcattctcttcaagaattccaaacgccagatccatgccaaattcatagccatcacaggaaatctgatcaacatcaagctgtcccagctcatctcgataatttctttcttccattgaagtcagtggtgtcccatattcatccagatatcccatatctgcaattgtttccagaatatctctggatgctttcaccattttgtccataatgatttctctttcttccatcggcatatttgccataatgctgtctaatgtcatcattgattcttcctccatctcattttcataaatatcgttgatataaaagtggtttgcttttccattgttcggaatgatacgcaccagatttccaacctccaccagttcctgtactgcctgatctaccccatatctggttgtattcaggtctttcttcatttcactttttggataaattacatacaaatcccccttaccatctacccaaccattctgcaccgcaaatttcaaacgatccagaaataagctgtataaaatctttgctgtatttgacagatttttgtatttttccatctggaacagcaccttcggcacctgcagacaatctaccggcatatactccatcttactcattgattgtttcctccttctgtttgtacagcacttcggctgaattaatattgatttccaacatccctacaaatacctgatagtacagaaggcatatctgttcatcctctcttgccagatacaatccttccagttcatcggacggatgtttcattccatatactgcctgacaaatatcatggattttctcacattccacacttctaagatgctgctccaaggtgtggttaaatctctgccagtcctccagtttctgatttactgacatcatgcactggaacagttccgctgcttcacatgctgctgacagcactacatttttgttattgatacttccatcggcatttttcatatgccctaccatatacgcctgatctactgaaaccatcttttatcctcctctatctaaacggcatttcttcttccatgccctctgggatctctaagaacccttccgcatcttctggaaacggtggtctgtcaaccatttttgcacctgcgaattcaatccggtttgcatacacttcggtggtataaatctttttcccggtatccttatcttcataattacctgtgacaatctcgccttccaccatgaccttcgtgccctgcatcagataatctctggcaaattctgctttctttgcaaaagcctttaccggaatgaaactgacttcatcggaataatttcttctgactgccagaacaaacttggcaatcttatgaagtcctttttcattctccacttcgttgtatccgggatttcttaccaatcgcccggaaataactgttgtattcattggcttaaccctcctatgctttcattgatttgtaacagatgccgatacatggtccacattttccataggcacatccgtaacattcatctttttccaactcttcttgcttcatttcatcggcaaacattcctaacagtgttgtataaatctttttcattgcaaggaacttttcttctgctttttccatcttctctttataaaatgggatcagttcacgaagaactggatggaaacgttcattttcatcatcccaggcacaggttttcatcatacaacgtggctgtttctcataattgcccagataatacgggcagaacgtacagcctctttctttaacaatttccatcggaattactggcatctgacttttgatttccttagttacatgcttactttcaattcgctctctcatattaaaaatcctccaagaatatatatttgcaaaagggacttcccctgaattgcctggttttaagcacaaaaaaagaggcagacttacgatttttgttttcgcaagcctgcctcttatcaatctaatattctattttccaatgacataccgtataaacacgtatatcgctctaatcacatacactggaatcatgatgcttccaatcaatgctccaatgatgacacttaatgcagccatcccaagtgttgctgtggtatccattcctctcggaatcagaatcaaccgcattttatgtattccaaatggaagtccagcaataaatacccaccagaaccaatccgtctgtccactgaccttcataattgtttttgtcatccaaaaccagaataccataaatgccagtggcagaatcgattttttaattacatcttcaatcgtcatcttttttctccctctgtctgattccttccgccacctcccgattaaggtttgccaatatttctctaaccacaggagaatccaatcgaaaggtttccagatctttctccgtaagctcccttccgttcgcatcatatcttcgtacaatttttaaagccatactttcacttccttcctgctgataatcctaatgttttcaacaaatgtttaaacttctctctttttatccgtttaacacgtatcttttctatctttttcagatagacttgtattctccttgccatatcttcattgctcattctttaccctctctttctgcccacgatgccagaagcataaatataatttcttccatctgagtctttgtatatgtatctggaaaatattgtttcaatttcttcgccggaatctgcacctgaactttttcagtactttcattcatgcaaatctggtcaatttctgaatacgtcaacatccgctcttttgaaatctgcttcaattcctttgcctgcttcatggaaggtaccatattgtgattactcatatactgaaataatatctgctgctcttcagttctcaaataagaaagttcaacagctgtgttaaagggaagcttcttctcgtctgccaattctaatagctctgctactaactctgtcagatgaatatatcgaagaatctgtctggaactatctcctgtattctgactgacttcttctgccgccaacttcttgccaacttggcaagaagttaaatcagatcgttttccctgacgctttaacgcctcatatttcattttataagcaaatgccttttcgctgatcagcagctcttctcgttgaatgttggaatctaccataatcaccgtcgcttcatcatctgtaagatctttgatgataaccggcattttctctagtccagcaagttcacatgctcgttttcgccgatgaccagctaccagctcataaccaccagactctctcaaccgcacaataccaggaaccaacacgccatattgtgtaatgctttctgataattcttccattttcttatcatcttttacttgaaacgggtgatttggaaatggatgaaggcttcctatttttatctcgcaaattccattgtttgtttcttcgtttgttccaaacaacgcatcaagtggctgtaaggaaatgggagttgctctttttttagatggcatcttctagcacctcctccgtcactctccgataagcctctgtagctttgcctttcggatcataagagaaaatactctgtccttctctgactgcttccttcattcttacagaaaatggaatataattatcaaagatatgaatttgacttccatatacatttctgagaagttccatattatttctggcatcatttgtatgcgcatcgaccatcgtgaacagaatcccaccgacttgcaacttcggattaatctgcttacgaaccttaccgatcgtttttaacaactgctgcaagcctttgattggcaggtaggaggcttcaactggaatgaggacttcatctgatgcagccagcgcattgatcgtaatcattcccaatgatggcatacagtcaataatgactgcatcatattgatccttgataccatataaaatctgtttcaatacatattccctgctcattgcatttaccaactgtacttccgtacctgccagtccaatgttagaacagataatatctattccctctgcctgatgtctgatataacagtctgaaggaatatcttcatctttcattactgcatccataagagctgtaagtgtttcattactgtcatcacaatcacgatatccaaatcctgcggatacatcagactgtggatcggcatctacaatcaacactttcatattcttttgtgctaatcctactgctaaattagctgtacatgcggattttcccgttccccctttttggtttacaatagaaataattctagccatttttcatcacctttcatcgtcgtcaatcaaaaagaggactgaattagacaaccggaatctatattccatgcgagctaattcagtcctataattacaataattctgttgtttttactcttgtcttacacaaatccatttccagtctggatctgtaataattcatattctggaatgacagcgctgccttatttttccctttttcagggagttaaaaataaggactaaattagtgcaaccccttgtatttactggagttttctaacttgtccttattataactcgaccatgcggcgtgatttttgataactgctctttatagattcgattatgcttagccaatgcccactcaaaatgcatttcccaatataaagcaacttccggcatatccttcttatctaaaaacagaaatcccttatatccatcaatcacaggttctttcttgggctttttacgattttcaacaatacgcttaaaacattcatacacttcctcagtcataggaatgattctagttccacttgacgttttggtatcttcaataacatacttcatatctctggttctttaaagctgatgatttacactgatttgcttttcttcaaaatcaatatcggaaagtgtcaatccgcagaattctgaaatacgaagtccggttttaaagaggataaacataccatcatagtatcgtttataatgctcatcattcttaataaattccaagaactttctttcttgttttctggttatggcttctcttgttacactattgtttacaactactgtacatagttgaaactcgaacggatttttacgaatcaaatcatcatctacagccatttgaaaagcaggtcttaccactccccgtactgaatgaatggtgctatatcccctaccatctgcctgaagcttaatcaaccatgcttttgcatctgatagttttaccttatcaatccttttggcaccaaattcctctttcttaataatgttgataacaaaattataattcgctgctgtattatggcgaaccccagtcttctgagcaatatacttttttaccaactcaagaactgtcaaattatcaccataaggagtaatgccatcatttatatcccttaatatgactttttccttttctctaagtgactggcaaggtcttcttcctaccggaagaggatctgtcgattccaacttccaactgtaaagaaatttctgttttccaaagcagtctgtataaacaaatgcatatcttccatccgctcgctggctttctccgtttcgtaaaatacgtccttttttatcacgtcttttctgattgcgatttctttcactcaaacgtctttgctcctttctacgaagaagccctagcacgacaaccatattatatcataccagggttgtatttaccactttaaagcgataaagtttcgtatttttcatttctacaaggatgtggtttgattaagaaattcttcaaatttatgccgattaatcaacgatttattcccaacctgcaccgtaaaacaataatcagtatcagtattttcagaaatcagcatccttatcttcttttcaccaattccaaaatattgaacagcctcatcgaccgttaacatatatttttcccaaatcggaaccatctttcccttcatttttgcttctatgttatctattatgaacacctccatattttcaaaataggcagcacattatctgcccatgacaaatagaaactcagctcctatcgtgtccaaaagcaataaaaaaaggacagctaaaaatctttcgacttataactgccctgacgctgttgtatcttcattaagaactgctaaaaagaccaaaaccgtaattataaaaacatcaacagtttcacaaaaaatcatggtgtttgtttatattctttaatctcattcagtatctcctccagctgctgattaatcgatgttatatctgaagaatcatatatctcttgtaatttattttctatttctgttatgtccggaggggaattatcatataaagtttgctgtatctccgtaagctgattttgaatagttattatatcagaattatcagtattaaaatactgccatagcgttatccccaatgaaagaaccaatgctaaatatgctggaattaatgttttgtttacatttatctcttcatttgttttaaaacctttttttataaatacatccaaccctgaatttccataaatttgcttatcaataaactgggagcaaataagttcattctctttgttatattcaaaataataatcaacataattcctatagtcctttatgcgatccatatcagctttaggaaaattatatggtaaatcgacattgtttaacactttcccattttgaattactttagcttcatctacttttttccccgtcttttcctcatgcttttgcgccttaattctaccatattttgtatctaaaattggtttatattcaaaaaacacctcataatcaacttttgtcactttttttcctacttctaacactaagccttctgatttaaggaattgccagatggtaagaaaatctttaatatctttaaaggaattagtgatgttaattcctttgaaaaagtcatattcaaatttagtggattcatctatttcaatgctctttgatgatccactatatgaaattattgctggcgcctcttcaaaatcttcttcttttggtataattggatgaaatgaaggcatcggaatccctaaagaattatttgttgatgttgtactgtaaaatgttttaactccatctttcagtttcttgtatttttttccgttctcatctatcttcatccgcttttctatatcttctttattaaaattgtagaatttagaaagattaaatgtccgtataaatgaaggaatatcttttatatcaccagacgctattttttttataattattctttgttgttttgtaaatttcatttattgctagggcccctttttgattctctgaaaatatacttaatttatattattatgacattcacatgtcaattaactgctcatcttctagtacgacacaaattctaacccctttatctcctaagtactttattgcatcttccgaaacacatattgtaaatgacataaaatccataaaacataaaaacacctcgcaaatcatcttatggtctgcgctatcatgtaagataatcacatgccttgcttttggttgtaatgtatccaaaattggctttatgctatttttaagctctatggatgctttaactggcaatgatgcgtattgcttaattattttatagtcaacacattccttatcttttttgtctgcaatacttgcttgatacagctggtttctaagtatttttgccactttatcttcagaatagctttctccaaataattcacatgtgtattcataagcaatttttattcctgccaataaatatctactcatgtctatatctgctggaatcgaaaatgtaggctgaacattctttttttcaccaattctatatgtatttaatatttcatgaatttcctcttccgattttcccattctttctaatcgtttacgtgcaattttcaagctttcttccaagctttccgcctcaatatgtaatacaccatcacgagtttccacaagtgctttcttccttggaatatcttctcgaaacaagtattgctcccctttttcatctgttaatatgctaggaaatatttttatctccttctcctcttttcctaaaaatcccaaattttttcttataattttggtaataatataatccgttaaatatttatccactttacttccgagtttgttattacacttttcacatactttataagtaactaacttactattccccatcgcttctggaataatatgctccttagaaccatccttttccaaatcacaaataatacatctcataatccgctctccttaatatacatcgtgtataattctacatttaattttttattttcaactaatatgttatcaaacaacaacgcctgaaacaaaacaccccccacattctccagccttaccattccatactctttctcagtaaagcccgctatctgtatctcttgcaaaatagcttcctttctcatcaccaaacaatgcgtatacaatgccatgatgtacttgtcagacattggaaaggcgtatgtttcgttcccttgatatgtatatcggcacctttccagattttcttgcggtatatcgaaataacatctgaccgtttcgagatatacatttccattatactgcggctttagcttccttgcataccttttgattgttgcaaatatgtttttcctgcatactggctgaaatcacttatccgcaacaaataagataacacctccaacaatttctcctttgatgttatctcctgatacgaataatctccaaattcaatatgatccagcttcaaagggctgctcccttttgctatctcacgttccatcactctgttaatatctctcatagattccatttgcaattttctccttcccacttctggacatcatgtccaaaagcataaaaaagcagctacaagtatttcactcataactgccctgacgctgtttctctattattctattcctgccgtttttgcaaacccggcttttctattcataagttcctcttgtttctcctttggcagacaccggaatatctcattatatcccattcctgccatcggtgttcctttttccaaaaggaaaagctgcgtgtcaagccattcctcccacaagttttcaaacatgctccggctatccgtaaaggtaattgcatcttcaaaactttgcggtggtctataatactgtaacttgacaaaaccgtatcttccagcatccacaacaagtatattctcaatctcatacatctctgcaaaagcatttgcaacctttctgcatttttccctttcactatctgtaatgtatatttctttcacaattaaccatcgcaaaattttgcaagatgtgtacagcaatcgtagtagaaacggagtagaactactcaataattactactcttcttcgataattagttctacattgtccgaaccgcaaactggacatttttcaggcatctttctagcctggtcgtaatcctgaaggaaacaatttttgcataacatatactctcttgaatataatacatgtctttttgcatttagttgataaaggatctcatatctgctaggattttttcctatgataaaatcaggagtaagaaaaattgatgttttcacttttaaaaatgtatcatcaatctctgtttccctataatcatagtcatcatacataaagatcacatatcttctctctcgttctccagaccatttagcatccttcaccgataaaatccaatattgcattatctcttctaagaatttctttttttccgcgtcactcatattaaacatatcaataacaccaaacaaatatgttaattcccgctttgcttcctcaacatcgtaaaataacatcaaacgctaaagtttgcgctatatacgggcgttccatttcatttggcatatcattttcaacgcctgcctttttcttcaaatgccatattccaataggcgctattaattcagaaattctatcatggtgctagaatataaatagtacaagccaaaatgagaaattccaaatacacataagcatgatacaatagaggcatgctgaaggaggatctcatatggcaaagcaacatgacaaacaatttaaacttgatgcagtccagtactatcaggatcacaaagatctcggagtacgtggatgtgcagaaaatcttggcatcggatacagcacattaacaaaatggctgaaagacttccgggaatcaggtgatattcctgttcgtggttctggtaattatgcatctgatgagcagaaggaaattgcccgtctcagacgtgaattacgtgaacttggaaaggcgttccagtgaatgtgaaagaggcgttggtaattcttaaggggcaaaattctgcgttgggttttcaaaatttgactgtctgaggcatatgccgagtttcaaattttgaaagcctgtttttagcagaattttgcccctttagaattgacccgccgatggaacctgaacaggaacacctttccaagctttattccggttcgggtatccatagccttcctgaattaaatcccaaattaaatccgatactgtgtatttttattactgcagctggctcagacggctgcggagtacaggtccgacgatgatcgcaatgataatcttcactgcgtcaccggcaagataaggaattactccgacagaaagtgctgcaacgaatgacattttcaactggatcgcaagccactctgtaccgaagatataagtgactgccataccgatgatcataccgacaactgccaggattctgttctttggaaatttatcaacgaacagtccggaaatcagtgcaaggaagatgaaaccaatcaggtatccgccggtaggacctgcaagctttcctaatccaccggtaaaaccggaaaatacagggagaccgacaagaccaagtaacagatatacgatgtaactgatggttgcatctctaaaaccaagtacatagatactgatcatgatcaccaggttggtaagactgatcggtaccgggctgaccggaatcggaatcgccataggagcgaagatacaggtgattgcagtcatcaaagcaatcagaaccagtttgcgggtggaaagctttttcgttgttgtgctatttactgtgttgttcatagtggtaattgtctgccgtatgacatggcagaactcctttcctttagttttatatcaaaaatataacagaagtataaaataaacaggataaaatgtcaactgtaaaagatagctggttaacaattggacatgcgcaagcgtatgatgttaacaaaagcatacgatttgaaaatgtatagtattgtgtaaacattaaaataaataaagaaaaatcagataattcaacttttgaaatggaataatgaaaaataaataaaattaattgcaaaaagtattgacaaaataaaagtcgaatgatattatataatcaatccaaaggaaatccaaaataaacaaaaaagaattcctgacgagaaagggaatcttgaaaattgaatatcacatattttataagatgtatttttattataaattctcaattcgtttaagaatcgaaaaatacaggatatagatatgaaatatctggtaaggcatcggatatcaaatatcgtaaagtatattgtagagaaagagaatggatgaataacgattatagaatggtatcaaggggatatggatcataatcgtagaagagatgagataataaattccagcttatatcttaagtgataaaagaaaagtttatcaaggatgaagaatatttcatatgtcggtgagatatcgttgattggaaatttatgaaaaggaggcttaatccaatggacacagtagaatcatcgaatcaatatgttagtggtatggcaggtagaagttcccagagaataagcctttattataatagataaaaggccggtagaggagattcggaaaaatagaacagacggagaaaatatacaccggacgataaaaagaactgcagacatattgaacagaataccacatatttaaagatattattaatatgtgtaaagaaacatgaatagtagatttgaatgaatgtgcaaagaagatgagtaaaagatcatcggaaagcatacaaaggcgacagggaataagaaataaaaaataaaaatcattctccgatataaaaattaaatatgataaaattgaatatgtaacagccatcataggaaagaatatgatggctgtttttttcgttgatatcagagagcagccggcaaatattttacagggataaaaaaattgtaatttttgtaatatttttttaacatatttggcgggatattttgacaataaacaggtcatatgataaacttatataagtaaaattgtagggaaatacgcttttttaaaataaacatttgaggtgagaaatattggataaatatgaatatagggtgaagaccgagcaaatgcttgatcatctggaaaagaaggagtaccagcaggcaaaggaaattgccgatggtatagactggcgaagagtaaagaatgcgtcaatgctcaatacagtcagtgagatttatgaatataacggtgagtttaagaaggggagagatatactgttcctggcatttgacagagcaccgggaagcagaaaaattgtatatcgtttaggcacactggcattgaagatcaaagatatcagagaagcaacggattgttatgaagaattcgtaaagctggcaccaaaagatccgaatcagtatattttaaaatataagattctgagaacacagggggcatcgctgacagatcagattacagcactggaagaatttaaaaaagcggaatatattgaaaagtgggcatatgaacttgccaaattgtatgatgaagccggaatgacagcagaatgtctggaagaatgtgatgatctgatcttgtggttcagtgaaggaaaatatgtataccttgcaatggaactgaagatgaagtataagccactgacaccacttcagcaggagaaatatgacagccgtccgggagcggttaagaagaaaccggaaccggagaaacaaccggaatcaacactggaagaagtggatgacgagaatgaatataatgaaagtacagaagagactgttgacgtacaagaagagccggtcagagagccagtgacagaaagagttgatgaatctgaagttcaggaaattcctccgcaggaagtaccgatgcaggaaactgttgtacaggaagagattccacaggaagtaccaatgcaggaaactgttgtacaagaagagattccgcaggaagaaattgtagaagaagctgcagaagaagtcgtggaagaagaaccggtatatactgaaccggaagaggctgcggaagaacatggatcaacgatcaaacaggttgtgacgggagctactttggaggaagctttagcgcagggcatggcggttgccaatggcattacaattgaagaagaagcaatgaaggagcgtgaagatgagattctggcgaatggtcagatgatgatcgatgatattcttcagaaatgggaagaaaaacagaaagaccacgaagcagcaatcgagaagcagaaagcaaaagatgaagagcgtcttcagaaagaaagagaacaggctcgtatccgccaggaagaagaacgcagagaagttgagagaaaagcggcggaagctgaggcaagaagaaaagccgaggaagaagaggcagcaagaaaggcggccgaagaagaggcaagaagaaaagccgaggaagaagcagcaagaaaggcagccgaagaagaagcaagaagaaaagccgaggaagaagcagcaagaaaagcagccgaagaagaagcaagaagaaaagctgaggaagaagcagcaagaaaagcggccgaagaagaagcaagaagaaaagccgaggaagaagcagcaagaaaagcggccgaagaagaggcaagaagaaaggccgaggaagaagcagcaagaaaggcggccgaggaagaggcagaaccgataagcaagacgcagagaattccggatgatattgtacgtctgatggaagaaatgggaaatgaagagtcggaagaagaactctatgaagaggattttgaagatggttcggaaacggaagaagacttcattgaaggaatcgaagaagaacttagcggaatcgatatgagcggaagcagttttgaagaagccgatttcggtgatgaagattttgaagaagctgatttcgaagaggaagactttgaggatgaagactttgaagaggctgatttcgaagaggaagactttgaggatgaagactttgaagatgaggactttgaagaagctgattttgaagaggaagactttgaggatgaagactttgaagaagctgatttcgaggatgaagacttcgaagaagaggacgaagaagaagctgatttcgaagaggaagactttgaagaggctgatttcgaagaggaagactttgaggatgaagactttgaggatgaagactttgaagaagccgattttgaagaagaagacttcgatgctgattttgcggatgtagaggacgaagaagaagacttcgacgatgattttgcagatgtagatgatgaagagacagattttgatgacgaagacttagagattgaagacgacgaagaagcggatgaagagttagaaatcgaagagccatcagaggaagagattcaggcaagaatcaagaaatctaaaggcggtgttccgttcgatacaggatttgttgtaaccggaagatatgatctgagtgctacgagtgagatcggtctgaaagctggacttacagaagaacagaagaagttgttctcatattttgtaccggtgagaggaatgagcgaacagatcgttgaagtacttgataacgacagaagggcacagagagaaggaacatccaagacaggtaaccttcttgtgattggtagaaaaggatctggtaagacagtccttgcggttgatattgtaaaagcaattcagaaacagagaagtctgaaacagggtaaagtagcaatcgttacaggtgaatctcttaataagaaagagcttacgaatattattcagaagctgcgcggcggagcgatcatcatcgagcatgcaggaaaattgaatgcgagaactgtaaaagagttaaattatctgatggagaagaagacaggagaattgctctttgtactggaagatcagagaaaacctctggagcgtctgatgacagcaaatccggaattcaagaagaagttcagttctaagctggagcttccggtattcatcaatgatgagctggtaacattcggtcagacatatgcgaaagagaatggatacaaattggatgagatgggaatccttgcactgtacagccgtatcgatgtaatgcagagagaagatcatgcagtatcagttgctgaagtaaaagagatcatggatgaagcaatctcacattcacagaaagcaaatgtaaaacatcttgcacgaagagtattcggcaagggaaccgacgattctgacagaattattctgaaagaagaagactttagaatttaacaaaaacgaatacctgtaagaagctgtcgagaacaggatttacaggtcggattttgaaagagttttgacaaactaaacggtcaaagctctttctttttgcctgtttgtaaagtataatgttcttataaatatgcagcagaatgcgaggggtaattatggctgaaaaaaagaaaaaaccatatgaaataggtgaattggatcaataccttttcggacagggcaatcattatgagatttatgagaagctgggcgcacatctggtacagaacggaaaacaaaaaggtgtgtattttgcagtgtgggcaccgcatgcgcaggcggtatctgtagtcggagagttcaatgaatgggacacagaggcaaatccgatgaagagggaagagccgctcgggatctatacctgttttataccaggtgtgaagaaggatcagatgtataaatattgtatcgagacttattcgggagaacagatatttaaggcagatccatatgccaattatgcggagttaagaccgggaacagcatccagggtcacagatattgagaatatcaaatggacagatacagagtggatgacacgtagaaagacctggaatcataagcacgagccaatgtctgtctatgaggcacacattggttcctggatgcgtcacccgggaagggaagatgaaggattctatacatatagagaatttgccagggcaattaccaaatacataaaagaaatgggttacacacacgtggaactgatgggaattgccgagcatccgtttgacggatcctggggatatcaggtgaccggatactatgcaccgacatccagatatgggtcgccggaagattttgcatggatgatcaattatctgcatagaaataaaatcggtatcattctcgactgggtaccggcacatttcccgaaggatgcacacggactggcagattttgacggaacaccgacgtacgaatatgcagatccaagattgggagaacatccggactggggaacgaaagtatttgattttggaaagaatgaagtaaggaacttcctgatctcaaatgcgttattctgggttgagacgttccatatagacggattgcgtgtggatgcggttgcttcgatgctgtatctggattacggacggaaggacggagaatgggttgcaaacaaatatggcgagaataagaatttggaggcgatcgatttcttcagacatctgaattctgttgtacttggaagaaacccgggagcacttatgatcgcagaggaatctacggcatggccgcaggttaccggagatgtagaagaaggtggattgggattcagtctgaagtggaatatgggatggatgcatgacttcacagaatatatgaaactggatccatatttccgaaaggataaccatcatctgatgacatttgccatgagttatgcatacagtgagaattatattctggtattgtcgcatgatgaggtggtacatctcaagtgttcgatgttgaataagatgccgggacttggatttgataaatatgcgaatctgaaagccggatatgcatttatgatgggacacgcaggaaagaaacttctgtttatgggacaggaatttgcacagcttcgtgaatggagtgaagaacgggaactggactggttcctgctggccgaaccggaacatcagcagatgaagatgtgggtaaaagaccttttacacctgtataagaggcataaggcaatgtatgagatggatcagagctgggaaggattcgaatggatcaatgcggatgacggatacagaagtatctacagctttatgagacattcgaaaggtgcaaagaagaatctgttgttcgtctgcaactttacgccgatggcaagagatgattacagagtcggagtgccgagaaagaaacagtataaactgatcctgaacagtgatgaggagaaatacggcggaaccggagcagatcgtaagaagatatacaaagcggagaagaaagaatgtgatggaagaccgtattcattcgcatacaaattgccgccttacggagttgctgtattcgagttttaattatatgaagtcagtggcaaaaaactttgatgcctgcggataaaaatgccgggaagtgttgaaacttcccggcatttttcgttttactagacatctttattaatgactgtatttagttggaagaactgtcggctgaggaatcagaagtatcggaaccagaggcatcggattcactgctgttttgtgtgttgctctggttatcagactggttatctgtactgtcattcgatgaagaatcatcagcagagttgtctgttgtgccgtcatctgaagaatcagcatcgttgttcagagaatcgttctgtgtgtcgccagacggctcatcagtgttatcagagttatcttctgtaatggcatcatcgttactcttgtctgtgtcgtctttcttagaattgcttccaccgaacagatctttgaagaacttcttgatcttgccccagaatccgctgtcatcactgttgtcatccgaagtatcatccgaagcggcatctgaactgtctgtgctgttggaagaattgtcggaagaatccagtgtactgttagttacgacatcatcaccgagtgcgctgtcatccgtgccgttaatgattccgccatcggaactgtcatcgccgccgaagatacctttgatagaactccagaggttggagaagaatccgccactctttccgtcaatgttatctaatgtattcttcagagctttgacatcatagtcatactgggaaatgtttttcatcagatcggagatcttgtcgatctgttcctgtgtcagcgtgacgttgttatccttggcagcgttttcaactgcattctgaatgtcatctgcatccgttaatccgccctcgatcacatctttttttacatcgttcatgacactttccgctttgtcctggccgatgttattggccagatctcctgtggtgacaagttcatcggtcgcagctgctttctgatcgtcattcagagttgttccggtggctttctcataagccatcatgatacctgtcagtgcaccggttccggatacttcgatcggagaagcggcaacgacattacagttttcaacaccggatgtcagaagcgtactggagatcatagagcttgtaacataagttaagttggaaacctttacctggattccgccgcttgtggtcggttctacataagaacagctgtaggtacgggtaccgatttgttcgtcgggagcgactccttccagatattttctttcatctgcattggtaacttcgatgacttctgctttgtcagatgaagttccgaaatactcatacatagaattcttctgtgaatcagtcagattggcgccaagtgttacgactttggatgaatctgctcttacaaccagtggtgccgcagtagatccaagtacgattgccatggcaactggtaatgctcttttaaattttttcataatgcgtggtgtgttcaccatgccccctttttattaaatatttttatccctgttacttttttaatataacataaaacagtgtgttttcctagaaaatataaattaactatttctaaagattttctgtagattgcgtccgcatctgcacagtcaacaacttctgcaggcgtgagtccagctccttttgcggtatcattccctgcatggtggcaatcagttctcggtctttgaaaatgagaaatgacggaagaagatcggtctgatattgcgcagcaagaagtgcggattcagaggtctctacttcaaaaaagcagatgctgccgaaatatttcttctgatatttcttttccagatcttctatgacagggcgcatcattgcacattttccacaccagacagcgtagaacatgactacagccagtgtgggatgctccggtccagcctttgccggtgtatcggaagaaaactgccagtggttcatccggcagatatcaaagttctgtgtcgtcagatgtaacataagcttccaccctttcccataagaaacaggagcataagatatgctttctattaatatatgaaaggaaagggaagaagtgcaggcagacaggattggtatataagtccggatattgcagcatgttatctgcgctttgcgatcagtttacagatcggattgcccatagaagagaacttggcttcatattcagtcataatattgccttgattcatcgtactgtcgttatgaagatcataggatagctgatccagaacgaaaagttcggaagtttcaagttcttctactgaaaagtcaaagagcggccggttgtcggtcttgaattctaccgttccatctgcggtcaggacctggtcataaagcttgaagaattcattggaagtcagtcttcttcttgcatggcgggctttcggccacggatcggagaagttcaggtagatacgtgatacttctgccggggcgaatacggttggcaggtcatttgcatccatacagatgaaccggatgttggcaggagctttcccctctgcttccagttcctggaatttctcaacggcacgcagcagaacgctggaataacgctcaatgccgatgtagttgatctgtggttttttggctgccagggtcagaagaaactgaccttttcccatgccgatctcgatatgcaggggctgctcttttttaaacgtctggttccagtctccgcgtaagctttccggatctttcacaacttctttgcaggcttcgagaacgctctctgcacgtggtatatttctaagacgcatacgtgtattcctccttataatcactggatttgcaaatcgttcttagtttagcgtctgtgcaggaaaaagtcaatggaagcagaaattgtcagaagaattgagaagaaataatacaatatatacaaaataattgtggtaattttaaaaaataggtgtattattataacatggataaaaaaataacaattatttgttgtgaaatgtgcgaaaaggagggcggcttatgaactctgtaattgaaaaattggctgaagtagagacgacggcggagacgatcgtagagcatgccagacagcagaagagtgaaattgaaagacagatacaggaagaaagagatcaatttgaccgggatctggaagaagagacacagaaaaaactggagaagataaaagaaaagtcgcagcaggaagtagagaaggtcctggaccgggaacggaagaagaaccagactgcaattgatgcgctgaagcaggaatatgaagaaaatcacgagatttatgcagaggaaatcgtaagacatatgatcgaggtgtagtgtatgggaaatgtgatggcttacagtgggattacgacaaaggtacgtgcaatgtcggcaaagcttttgacagcggaggattatgacataattgccggacttgggacagtaacggaagcaattgaatatctgaaagacaagacggcatatgcaccttatgtgaaccggatggacatttctctgtatcacaggggaaatgtggagaagatcctgtatcagtctctgttcgatgattattcgagactcttccgttttgccggaatgaaacagaagacatttttaaaattatactggaaacgttatgagattgatctgatcaattattgtctgagaattgtgttcaatcattatgacaagccgtttgacctggaatataagaaagagttttttgacagatattcacagatttccattgaccggttgataacttcgaaaaatattgatgagcttgtggataacttacgggatacggagtattatgatgcacttgccagaattaaagattccggagcgggaacgctttttgattatgatctggcactggatctgtattatttttccaccatgtggaaaaagggaaaaagagttctgaaaggacatgaacagaagatatttttaaaagattacgggacgaagatcgaccttctgaatctacagtggatctaccgtgcgaagaagtattatcatatgcttccgccggacatttattcgatgacgatcccgattcattaccgggttcgtgtggaagagttcaagagcctggtagagactccgacactggaacagttcgaaaccgaagtgggaaaaacgtactatgcgggaaagtatgattatatgcaggcagataagacactggaacagatgtaccgtgattgtctgcggaaattgtacctgaccgataaaaggaatgatccgtattcgatcgcgatcgttaatacgtatctgttcctgaaagaagaagaaatctataaactaacgacagcccttgagtgtatccgttacggtttgacgaagggagagacattaggatacttaggaggtgtgaatcaatgattgttaagatgaagttcttaagcatcagcggaccgaagaatgacatcgaccgtgtctgcgaggtgtatctgtccaaatacgagatgcagcttgaaaatgcggcggcggagcttaagacgaccgacaacctgcagccttttgtggaagtcaatccatacaaagagccgcttgcgaaggcagaacagtttaacgcattgttatctgatgaagaccagcgaatcgatgcatcgatgaaccaggatgatatgctgagtctgatccgggatgtcaatcatgactatctggatcttgtggaaaagaaagagttaacgaagaaacaggtagaggaatacaaagaaaagcttctgatcatggagccgttccggacattggaactggatatgcagaaatcactgaagtacaaatacatgaaagtacgtttcggccgggtggatgtgaattattacaaacgtctggagaaatatttgtttgatgatttgaatgcggtatttatcgaaggcataaggaatgaaaattatgtgtacggatgttatttcgtatcgaatgcagattccagtaaagtagattcggtattcaattctttgcattttgaaaggattgcaattccgtccgagtacataggaacaccggagcaggcctgtgaagagcttgaaaaggcaatcgaagaaaagcaaaaagagattgcagagatagaaaaacagatcagggagctgatggcaaagaatgccgcaaagctccgtggtgcgaaaaggcgtctggaagaactgtctacaaactttgatgtacgtaagctggcggcaaggatcgaagagggagataataaagaagattattacatcctgtgtggatggatgggtgaagaagatgtgaaaaaattcctggcggaatcgaagaacgatgataaggtattcgttgttgtagaagaagataaggagaagtttttcggagaaccgccgacgaagcttaagaatccaagattcttcaagccattcgagatgttcatacggatgtacggacttccggcaaatgatgagatagatccgacgatgtttgtggcactgacgtatacatttatcttcggtgcgatgttcggagatgtcgggcagggcttatgtctgttcgtattcggcgggcttttgtatctgatcaagaagatcaacctggcagggatcatatccattgcgggactgttctcgacattttttggattcatgttcggaagtatcttcggatttgaagatgtgatacaggcacgctggttaagacctgtggatgcgatgacgaacctgccgtttatcggacagctcaatacggtattcgtggtagctattgcatttggtatgggactgaatatcctggtgatgatctttaacgtgatcaacgcagttaagagtcatgatctggaaaatatgttattttcccacaacggaatcgcaggactggtgttctatggattcctggtgctgacgatcgtgctttatatgacgggacataaggttccgggtaatatcatgatggtaattttcctgggggttccggtgctcttgttcgtattcaaggaaccgttgggcaatctggtgacaaagcagcataagaagatggaagagggaaaggtgatgttcttcgtgcaggcgttcttcgaactgtttgagacgatgctgagttatttttccaataccatttcttatgtgcgtatcggtgcatttgccgtcagtcatgcggcgatgatggaggttgtgctgatgttatcgggcgcaagtgcggggcatacgaactggatcgtgttcatgcttggaaatgtgctggtgtgcggactggaagggctggtcgtcggtatccaggtactgcgtctggaatactatgagatgttcagccgtttctataaaggaaccggacgggaatttaagccgttccacagtcagagtgacagaaagtaataaaattcaaagatatatttacaggaggacaaaaatatgagcctgacagttagagtattattcgttgtaacattgttgctgagtattgtaattccatttggatattttctgatcggacagaggacgaagaagcgttataagagggctatcggcacaaatatattctttttcttcagcactgttctgatcgcagggatcatgctttttgcgggagatccggtacaggcagcggaagcagccggcaatacggcgtcgaacgcaacaggattcggatacctggcagcagcactttcaaccggtctttcctgcgtcggcggtggtatcgccgttgcaagtgcagcaagtgcggctctgggtgcaattagtgaagattccagtgcacttggtaagtcactgatcttcgtaggtcttgcagaaggtgtgtgtctgtacggactgatcatctccttcatgatcttgggtaaattgtaagatgaagatgtatctgatcagtgataatatcgatactctgacaggaatgcgtctcgcaggggtagacggaatcgtggtacatgaaagagaagaactccggtgtgcgatcgagaatgccatggaggataaagatgtaggtgtgattctgttgacggagaaattcggaagagaattcccggacctgattgacgagatcaagctggagcggacaatgccgcttttgatcgagattcctgacagacacgggaccggacgtaagaaagattttatcacgtcgtatgtaaatgaagcgatagggttgaaattatagacaggaagaaggtggcacatttgacaaacgaagaaaagatcacgcatatccgcacggcagcgatggaagaggcaagagcggaggcgaatgcgatcataaagcagcatgaggatgcgctgagaagtgtgttcgagcagcaccagatcgaagccagacggcagtcggagacgagagtgcgtgcggagagtgtgactgcaaaacagcagctgaatatggcgatgtcaaaggcgcagcttgaattaaaacgtgagatgggtaagatacagacagaacttaagacagaactgttcgaagaagtacagttaaagcttctggaatttatgagaacagaagagtataaagaggttctgatccgttatatagagaaagcagcacagtttgcatccgggatggcgatgacgatctatatcaatccgtccgatgcagataagaagacatatctggaggagcgcacgggaatgacgctgacgatcagcaaagtggatttcattggtggtgtgcgtgcggttgtgcctgagaagaatgttctggtggattatgcattcaaaggggcactggaaaatgaataccagaaattccggttccggggaggtgtaaagggtgagtagcggaaagacagaaaagatatatggcatcaacggcccggtcatttacctgaaagggaagacggattttaagatgtcggaaatggtccatgtgggagaggaaaagctggttggcgaagttatttccctggataaggaccggacgacggtacaggtgtatgaggagacttccggactgcatccgggagaacttgtggaaggtacgggagcggcagtgtcggttacgctggcacccggtatcctgaataatatctttgacggtattgagagaccgctggagcggattgctgacaagggcggggcatttatcacccgtggtgtcagtgtggatgcactggaccgccagaagctctgggagacgcatatcacagtggcggaaggcgatatggtacagggtggaacgatcattgcggaagtgccggagacgcgggctatcgtgcacaaatgtatggttcctccgggagtggaaggaactgttatatctgtggttccggatggtgaatatacgattgatgagacgctggttacgattgaactgttcaatggagaaaaacgagaactttcgatgacacagcactggccgatccgtgtaccgagaccggtgagcaggagattcccggcaagtgtgccgctggtaacaggacagcgaattctggatacgatgttcccgattgcaaaaggtggaacggctgcgattccgggaggattcggaacgggtaagacgatgacccagcatcagatcgcaaaatggtcggatgcggatattatcatatatattggatgtggcgagcgtggaaatgagatgacgcaggttctggaagagttttcagaactggtcgatccgaaatcaggaaatcctttgatggacagaacgacgctgatcgccaatacctcgaacatgccggtggctgcccgcgaggcatccatttacaccggacttacactggcggaatattaccgtgacatgggttatgatgtggcgatcatggcggactcgacatcccgatgggcagaggcactgcgtgagctgtccggacgactggaagagatgccggcggaggaagggttcccggcatatctggcatcgagactgtcggcattctatgaaagagccggcatgatgcagacattaaatggtgcaaccggatctgtctctatcatcggagcggtgtctccgcaggggggagatttctccgagccggttacgcagaatacgaagcgtttcgtgcgctgcttctggggattggataaatccctggcgtatgcgagacatttccctgcgatccactggctgacgagttacagtgaatatctgaatgacttaagcggctggtattcggatcatgtgtcgccgaaatttgttgattacaggaaccgtctgatggcgatcctgaaccaggagagcagtctgatggagattgtaaaactgatcggcggggatgtgcttccggatgatcagaaactgatcctggagatcgcaaaggtgatccgtctgggatttctgcagcagaatgcatttcataaggatgatacgtgcgtatcgctggagaagcagttcaagatgatggacgtgatcctgtatctgtataagaccagcaggaaactggtggcaatgggaatgccgatgtcggtactgaaggcggaaggtatatttgaaaaggtcattgcgatcaagtatgatgtgccgaatgacaacctgcagttactggatctgtataaattagacattgatgacttctataaccgcgtcatcgagaagaatgcgtaaagggagggacgtaagatggcaatagaatatcttggactgagcagcataaatggccctctcgtcgtactggaaggcgtggaaaatgcattttacgatgagatcgtagaatttattgtagatcataatacgaggaaaatggggcgtatcgtagagctggatgaagacaaggctgtgatccaggtatttgaagggacagaaaatatgtcactggataatacccacacaagacttacgggacatccgatggaagttactgtatcggaggaaatgctgggacgtacatttaacggaatcggagaagcgatcgatggacttggtccgattgcagatgcagaaaaaagggatgtaaacggacttccgttgaatcctgtcagacgggagtatccacgaaactatatccgtaccggaatctcagcgattgacggtctgacgacactgatccgcggacagaagcttccgatattctcgggaaacggattgccgcatgaccagctcgcggcacagatcgtaaagcaggcttcgcttggtgacaattcggatgaacagttcgcagttgtattcggagcaatgggtgtgaagcacgatgtggcggaattcttccgtaagacattcgaggaaagcggtgtggcagatcatgtgtgtatgttcttgaatctggcaaatgatccggtggtggagcgtctgatcacgccgaaggttgcactgacggtagcggaatatctggcatttgagaaaaatatgcacattctggttatcctgacggatatgacttcttttgcggaagctatgcgtgaagtgtcttcttcccgtggcgagattccgtcaagaaaaggatatccgggatatttatacagtgaactggcaacgatctatgaacgtgccggtattgtggacggggcaaatggttccgtaacacagcttccgatcctgaccatgccgaatgatgatattacacatccgatccctgaccttaccggatatatcacagaaggacagatcgtactggaccgtaatctgcacgggcaggcagtctatccgccgatcagtatcctgccatcgctgtcacgactgatgaaggacggcatcggaaaaggatataccagggaagatcatcaggatcttgcgaaccagttattctctgcctatgcaaaggttggagaggcgagaaatctggcttcggttatcggagaagatgaattgtcaccaatcgataaacagtatctgaagttcggtgaagaattcgagagacgctatattggccagggaccggcggagaaccggacgatgatggagacgctggatcttggctgggaactgcttggacttctgccgaaggaagaactggaccgtattgatacgaagctggttgagaagtattggaaggatacgaaagagacattggagacagaagagtaggagggatgcatatggatccgagagaatttcctaccaaaggaaatctgatgcttgcaaagaattctctgatgcttgcacgtcaggggtatgacttgatggataaaaagcggaatattcttctgaaagagctgatgggactgatcgatgaggcgaaagacattcaggaagagatcgatgcaacctttacaaaagcatatgcctgcctgcagcgtgccaatatcgaacacgggatcagtaaagtccaggaactggcatttactgttccgatcgaggattcgctgaagatgcagaccagaagcatcatgggaacggagatcccgcacatcaagtatgatgcgaagcagaatgatctgacgtattcgttcagcacgacacatgagtcggtggatattgcaagagaagctttccgggaagtgaaggaacttacgatcaagctggctgaagtggagaactcggcgtaccgtctggccgcaaatatcaagaagacacagaagcgggcgaatgcgcttaagaatattacgataccgatgtatacgaatctggtgcatacgatcagtaatgcgctggaggagaaggaaagagaagaatttacacggttgaaggtgataaagaggatgaaaatgtaacgacaaattttgcaaagtaattccacttatccccaacaaaagaggagttatccacgggaaactgtggataactcctcttttgtctgataattccaatgcatgaatcgacatagaatgacaacgattataatgaacgggatttttctgtacttacattaatgcattcgattacagcaccacgcatgccggctttttcaagagcctcgcagccttcgatggttgttccgccaggggatgtgaccatgtcttttaattcacccggatgtcgagtgcgccatagagaatggcaccgcccatattgccacatccgataattccgatttctttgtgatcataataattcctcctagtttggtcatgagatgttttagagcagatatttataaagtgtacagtatgcaatgacaggagctttaaggagtcagcttgtgcagttcccatgctttttcgatacttcccggagtttccatcagtaatttcgttccttctgccatacatctcgcaacgtagaacatacctttctgtccaatagtcataccggcctgtctggcagcagcccagtgatgaagcggggtacctttacacatcgtagcggcacttaaggtgatcaacgggacggtgtggctgacctgtgaagcgtccgtgccgatagcgatcggaaccggttcatcttcaagcggttccaggccggagaatagtgtcccgtcattgatgagtccggcttcttctgtgatctgctttgcaaaatccagctcttccggtgtataagccggtgccggaactctggtcatagcatcgtaatataattctgtcagtacccggttaactttcatctcactgcagcttgcgaccagttcgatatcgacggtggtgtctgtcataagagcggcacctctggcgcagttgtctacacgttcgcttgcatcttcggtgcgggaacgtaagtaggagcggatgaaataatttgtctttgcgatatccggaacaacatttgccggaagaccgttatcaatgtaggcataatgcatacggacatctcccggtacgtgttcacggagataattgacgcctacattcatgagttcggcggcatccagggcgctgcggcctttttccggtgctttggcagcatgggaactaagtccgtggaatgtgtagttcttaatgtcctgtgcctgccagatatcgttgctgacacggttacggtcgaatggatgccaggtaatagcaacatcgaggtcatcaaagactccctgatcgttcatcacaatcttgccggacatgatctcttcggccgggcagccatagacgcagatcgttccggctgcaccggttgcttccatttcggcttttaatgcacatgccgctgcggcaacggctgttccaagcaggttgtgcccgcaggcgtgtccgacacctgccagagcatcgtactcggccaggaatccgaggattggttttccacctccccagactgcggtaaatgcggtgtcgataccggctgttttccatgttattttaaatccctggctttccagataatctgccaggcatttggaagaaagtgtctcctgatatgcaagttccgggtgatggaaaatgtaatcagcggtattcaccagttcttcctgatgatcgtcgagccagctggcaatgatattgtcaggtgtatgttcagttgttagtgtattcaaaatatagatacctcctcatagaatcgggtgtttatctatcattttagcacaggaaaacaggatgtaaatagatttcatagttttcttatatgaaaagtaaaagctattcaaccggataaagcccgttcagtacatccagatattcctgtccaaatgtatctacattgacgcaataatatttcccatattcggtaatgttatgcttttcccatgcttcacaccatgcacattttgcaatgtaagtctgaagtgtcggttcggtgcgaagtgttccgaagtccatttgtccggcgtaatctggtttccattcaccgtatgcctgattggtcatggtagtcagttcatcaccgtgtgcgaacatcatggcgtgatgttcgattttgcagctgacaggacagactttattttcattttcactcatattaaaaactcctttcgacatttgtaagtgataatctatttattacaatactacgttgtagtgaaaaagtctcgagaaaaggcttgataaaaaggaaaaaagcggtatgatattaaaaaaggaaaagcaattacttaaaagtgagaataaagttgaaaattagagaggaaaaaagtatgagcaggaaaaagttaaaaaatagaagacgaaaagatcgtgcacagagaaagattctgattgcagcagtctgcatagcagcagtgatcataggtgtgggaatcggcgggcatgttataaaaaagaatgccggtaaaacgatgacaacggccaagatggaaagtaaaaaggcagtatcaaagaaaaaagaaactgcaaaaaaacttacgatcaatgagaatgaaactgatgcatccaataaagaaaatcaaggccaaaaagatcaggcagatgacagaaatgaatttgcagttcaaccaggaagaaaagtgggtacaacagaacaatcggatgaaaaagttgtctatctgacgttggatgacggaccgtctaagaatacgcaggcggtgctggacattttggataaatacaatgcgaaagcaacgttttttgttacaggagccatgccggaatataaagatatgatcaaaaaggcttatgataagggacatacgatcggaatgcatacatattctcatgattacgcaaaggtgtatgcatctgttgatgcatattttcaggatcttgaccagattggacagcttgtaaaagaagagatcggctatgttccgtgttttatcagatttccgggaggatcttcgaataccatatctgcaagttacatgaagggaattatgacaacgcttacgcaggaggttcaggcaagaggatatcaatattatgactggaatggaagttcgggagacggggccgtgagaacaacggaacagcttgtgaatcaggcaaccagtttccatgacaataatatcatcctgctgtcacatgattccgagacaaaagatacaactgtggaagcgctgccgaaaattattgaatattatcagtcacagggatatgtgttcaaagcattggatcttaacagctatgttgcacatcatggtgtgaataattaattatatatgtagggaaatgtgttgatggttgttgtacttatgctgaatagaataacggaagatctggcggaaaacatgtaaatacaaagaagaaaaatgatgttatcaaccagagtgagactacaaagccaggttctgtctcgtgaggagaaagggtcttgccggaaatatattcagacattccaaatgaaaatattacactggaataaaaaagcaggatgtctaagatcaggaaattccggccgagaatcccggaatatgtgtaaaaaacagaaacagtaaaaagcattccgagaagcacacccagataccgacagtaaaagaacggtaaaacaaccggatgcagagacagatattcccatatgcttacgaataaaaaaggaaaatataaaagtttcaaatgttcccacacggattcattaaccgggcagaaaagtgcaatgattggagactgcccggataaaaaatacaggaaatgattcagtgttccgagaaaggcagcgaccaggacaaaatgcagagctgtgccttgaatgcaggagataatctctgtgcagacagtatgaaagatttttttgaaattggttgtaacataatggataatatggctcataaattcaccccccatatcaatatatgagagctgtgaaaaaaatatgaaaaaaataaaaaaagtacttgcatttttaaaaaccttattatataattaatcttgtcgttacggaaagcgtgacacagaaaattgaaaatgcgcgattagctcagttggtagagcacctgactcttaatcagggtgtccagggttcgaacccctgatcgcgcactatcaaatcactgtttttagaggcttagagctctggggacggtgatttttttgtgcctgaaaataggggctttagagggataacacggaaatcattagagaaagcaaagatggaaaggaaagaattatgcaaattatttccggagaggattttacaaaataccggataaagcttgtgacgggaacatgttcgtgttagtataatcataatttacgatagaagaaaagagtgagaagatgagcagtcatacactggaaggaaagaaaaagacacagaatggtgtgaagcggctggcgttcacagtgctttcgatattactggaagtagtgttcctgattgggatatttaagggactgaatgaatacgcggtattcatagacaatctgaccagaatattcgccgtcatactggttctgaaaatatatggaagaaatgagacttcctcgatgaagacaccgtggatcatcctgatcctgacatttccgatccttggagtagcactttattttatgatcggtatgaacggtggaacccggaagatgcggatgcgttacaaaaggattgatgagaagcttctgccacttttgccggaaaataaggaagtgctggaacgtctgaatgtgtcagatccgaaggctggaaatgtttctaattatatagaaagaaatgcgtgttatccggtgtatcagaatacggatgtgacttattttgatgaagcggtcaaaggactggaggcgcagcttacggatcttgcaaaggcggagcaattcattttcatggagtatcatgcaattgaggatgaatatgcatggagcaggatacagacggtgctggaagaacgggtgaaagcaggagtagaggtccgggtgttctatgatgacatgggctcgatcggattcgtaaatctgagctttgcgagaaaactggaagcgaaaggaattgcctgccgggtattcaatccgctgcttccgggacttaatatgttcctgaataaccgtgaccacagaaagattacggtgattgacggaaaggttgggtacacaggcggttataacctggcaaatgagtattttaactatacacatccatacggggaatggaaggatacgggaatccggctggaaggagatgcggtggcttcgcttacggcagcatttttggaaatgtgggaagcgtccgggaagacttcggccgatgtggatgttctggatatagaggcacagaaaaaatatctggtacagcatccgtatcaggcaaagcagacgggatatatccagccgtatgcggactgcccgttagacggaatccaggttggagaggatgtctatatcagtatcgtcaacaaagcggacagatactgctggttcatgactccttatctgatcatcacggatgagatgacacatgcactttcgctggcggccaggtgtggcgtagatgtgcggatcatcacaccgggaatcccggataagaagctgatctacagtatcaccagatcgttctatcacaatctggtacaggatggtgtaaggatctatgagtggacaccggggttctgtcatgcgaagatgagcgtggcagatgattgcatggcgacttgcggcacgatcaatctggattaccggagcctttatcatcattttgaaaatgggtgttttatggcagattgtgatgcggtgctggatatccggcgggatatggagcagacattggaacagtgcagggaagtgacggagaagtataagtccggccggagcgcgactctgcggctgggacagttgttcctgcgattgtttgcggagctgttgtaggaaagaagaaggtaaagggactgggaatgcaggtttgcatttccggttctttttattgtatattgacatatatcgagatgcgatatataataaaaccaagaagaaagcaaatttttttacactcaactatcgaaagccgatatataatgaaagcaaatataagaaaggagcaatcactatgaaagtaaacaaaaatatggtctcaggaaataccgcaatgttaattctcaaattgatctcagaaaaggatatgtacggatatgaaatgatcgatacactctcaaagagatcggacaatgtattcgaattaaaggtaggaacattgtatccgctgcttcacagcatggtacagtccggatatttggaaagttataaccaggaggcgaacgggaaactcagaaagtattaccggatcacacctaatgggaagaaatatctggagaaaatgatcgaagaatggaatgcttatgccaatgcagttacgagcatgatccagtattccgtatagcacaggtaaggcagtgaaggtggtagaaaaggagggtgttagatatgaaggaaagagaatatctgaaagaacttgggaagaagattaccgattcgtctgtaagaaaagagattgtaaatgaatatgaagcgcatatagaagactgcaaagccgcattaatggaatcagggatgacggaagttgaagcagaggaagaagcagtccgccagatgggcgatccgcaggaagcaggtgaagcaatggataagatctatcataaagtgtttgattccaatatgtttctgtggatgctggcactgggatgtgtaccaattgtatgtgtgtgcatttcttatcttatcgcaagagatccgaacgcatttttatggttgtggaatgatgcgcttggcctgaataaaattccggcagttatacaccggaatatcggaatcggattagctgtctatggaatcggattgagcttctgggagaaatacacgggcaaagctttattctatgcagtcggaagagactgggggcagggatgttacgttgcaaacagcgggctggtactttttatctcggcattatgttttgctccgagcttcccggtgaagggatatgcaggaatcctctgctgtgtattgatagcatgtctgttgaatatggtactgagaggatttatgaatcttttgcagagcagaagagagaccagacttttatgggagattggaacggcagataccagaatcaactggaaaggaaaaggatatctgtgtggacatcatatgaaagtaagagtacagggatctgagaaaggaacggagatcccggcaggagcaccggtgatggttgtcggaatggagggatttaagccggtggtggcgcaggtataaagagagagacgttagatcttggatagtaagcgtatatgaagagagacgttagatctcggataataagcgtgtatgaaaaatgagaggcaaaagttatgaataagacggaaaagcgaatgaagatattcacgctgatcatgcaggtgatcatccaggcagtgctattatttccgtggatgaacatggggacatggaaatgcaatgtaccgggatatctgataaaattggctgcttcgggcgatgggatgagttacataaagaaaagtctgaagcctttgggagtactggacggtgcagatgaacagatgatggttcagatactgatgctgttcatctgtgaactggtaatggtactggtaatccaggtgataggaattgtgaatctgatactggctttaagcaatcaccataaactgcttctggatatcatgtcactgatcgcaggatgtatgatatcatttcttggggcagatggggcagtattttcagatccgttgtcacaggtgtatccatttttactggtagtgcttctggtgatcaatttgatcggtgcgaagctgattgattcgtggcaggaagagaaaaagatacaagaagaagttaaagccagagagaaaaattacaaagaagaaaagaaaaagcatctggaattttcggggaagtatccgaaaggattctatacggccctgtggaagaattttaaaagttcaaaaagagattttattgtttacgtaagtatgaacctgcttccggcgacgctgatattttccggagtcggaatggcacagatgctggcaccattcaataaagaaggaaatatactgacggggcatggaatcacggcaattctgctggaattcctgatcgtgagtctgatcgcatcgctgatgctgatgatcacgaatctgttgtcatatttcagaaaacggatgagaaattacagtatattttcgactctgggaatgcggaagtctacactttatgaagtgcttggagcagagattgtggctggaattctgggaatgctgatcgggggagcctgcatcggaagtgtgatcctgtgtatcatccgcagaatcttcatggcaagatccggagtgggagcacagccggcgaagattacaggattcacatatttgatcgcaagtcttatcctgatcggaatatccgggattggactgatgatcctgcgggatttcttcctgtacagggaactaaaaaaaatgcagctgggcgatgtggaaaaggagaagacgccggaaaaacggatcggtctgtggcttacaattggcctggtcattgtggtatttggaatagtgaatttcggaatgcggaagaatgccgaagggttacggatacttttatttattttcctgggtatttatctggcggaaaagtttggatttggattgttcctgaaagtgcggaagcataaaaagagttattatgcaaagttgatcccatataattcgttttattaccgtttcaagagtacattccgttatgtgtacgtgatcagtcttataccggtactgatattgttcttatttggaaaagatatgatctcagcgaagatcgcgcaaaagccggaaggactgttcccgtatgattttgtatgtatggcaacggaagcggatgagacattctggaaacagctgcaggaaaaatatgacgtgaaattccaggagtatccgatggtacgcgtgacgaatgtggataattcggaaaagctggatgatgccagagcagtgatcatgccgcagggacagcatataggcatctcggagacgacgtataaagaactgaataaggcgcttggaaagaaaagtgaaaaaatgaatctatctgctgacggaaaggaaatctatattatttaccaacaggacaagagtacgaaggcacatccactggattacctgaattcgagaaaagagccgtacctgcacatcggacagccgatagaatcttatggatttcttgatcgggaaaagatctatccgacacgaaccgtaaagggggaaaagatggatatcctgacaggtgcattccggcagggaagtgaggagaatctggttgtattttcggatgaatattttgaaaaggttcaggacgactggaagaaatataattggatcaccggagatccggttgaggagggtgaagcagaagaaggagtgacgatccatcactggccgacaaagcttgtccttttgaatgtgaaaaatgcagattatcagaagatagaaaaagagctccaggcttttcggaaggtacataaagaggatgaaagatttgacaaggatgtattatcctgctattccaaacgtacatcgatggaacagattgaaagcgaacgctttatgacaacggtagtagatatatttatcatgggagcatttctgctgggaagcgttctggtcatttacttgaaatatgaatctgagatgacggacaagaagaagcggaatcatttcttaacctgtattggaatgagctcgaaagaaagagaaaagctgatccggacagagacgggaatctttttctggatccctgcagcagttgcggttgttatggtgccggtgttaaccggggagatatggaacatgcgggaatatacgaaggctgactgtgtacattatctgcgatatctgttgatctttgcagttatatatcttgtagtgcagggcatcggtgtaaaggtgattgagcagtatacaataaggaaggtagaaggaaagcatgaaagaaatattaaaggtaaataacctgatcaagaaatttccaaaagccggtggggagattgatgatgcggatgcgatttcggtactgaaaggcattaactttgatgtagaacagggagagtacgtcggaattatgggaaaatccggctgtggaaagacaacacttctgaagatcctgggatttatggatcagcagacggacggagatgtgatctttgacggtgcgaatacgaatgagctgtggaaagaagaacttacggatatcagacgtagaaagatcggatttgtattccaggattttaatctgatggacagtctttcggtaaaagaaaatatcatgcttccggtattgctggataaaaaggaacagaaagaatgtgaagagaaagcggaaacattggaaaagcagtttgggattgaacatcttcaggaaaagaatccttatgaactgtccggcggtgagcggcagagagtggcaatctgcagggcgctgatcaatgatccgagtatcatatttgcagatgagccgacgggaaacctcgactcaaaatccggaaaagttgttgcggaggaattccggaaaatcaatgaggagttagggaagacccttctgatggtaacgcatgatccacagatggcaagccggtgtaagagagtgatatttctgaaagacggatatgtgatgaatgatgtgagaaaagagggcacggaagaagaattttacagaacgatcattggggagatggagaagttttaagatgagataatatatagatggtgatatgggctatgcggcggaagataattctgccgctttttttacgaaaattaatcttgtaatcatatgaacaatatgctattctgaatgcacttcaaagagtgacttctacaaactcttaagtatttctaggccaaaaggcatcaagtttcgaccgtttcacacctaaaaatgtctgaaacatatttccgacttgagagaacacgaaaattttataatctattcaggaggacgtgcctatgacaaacaaacttcaacagtatttcccgatgattcggacaagggaggaggtgttgaatgagattgaaagtaaaagcagattaaaaaatttattttatgagtggacagaggaaaatcaaaatgaatttctggatttttgtaccggagtgaaaggtataaaaatcatgtatgatttcatgataaaagaaattctgaatccggagaatacaccggagagagtaaatgaattactcacgttacttctcggacaaagagtgagaattgtagacgtattaccaaatgacggaacaagattagcagatgaatctacgtttcttattacagatatggtagtacaactggaagatggaagtattgcgaatctggaaattcagaaaatcggatactattttccgggagaaagaagtgcctgttactcagcagatctgttgcttcggcagtataagagagtgagaggaatcaaaggaaaacgattctcttacagagatatcaagcaggtgtatacgatcgtgttatttgaaaaaagtccaacagaattccagaaattttccaataattatatccatcgttttatgcaaaaatctgatacaggagtaaatataaatttattacaagaatatctgttcatacctcttgacatattcaaaaagaatcagcaaaatgaaaatagaagtgtaaaaatagaaaaccggctggaagcatggcttgcatttttctgcatggatgatccggagacgattatagatattatagagaaatatccggattttaaagaaatgtatgaacaggcttatgatgtctgccggaatatcgaagaggtgatgcagatgttttcgaaagaattgctggaattagatcggaatacagtaaagctgatgattgatgatatgcagaaggagatagactgccagagagagcagttgagtcagaaggataaggagatgttagaaatgaggaaagaaatacaacgattacagcagctattggataaaaaatagcatgaaaaatgtcaaaagaattgttttagatacttataaaaataactagtcagttgaaagaggtgatgtagatgttttcggaagaattgttagaattagatcgaaatacagtagaattcatgattgaagatatgcggaggcagatagaagagaaagatgagcagataaaacaactagatgagcagataaaacagaaagatgagcagtcaagacaactggatgaacagataagacaacggaataaacaaataaaagaaagtgataagcaaataagacaactggaggaacagataaaagaaagcgataggcagataggacagttggatgaacagataaaagaaagcgataggcagataagacagttggatgaacagataaaacaatcagaacaagaaatacaaaaaatggaggaagcaaaagagtaatacatagcctggctgtctcaggaacgtgaaacagccagaccgcttacctcaaagcatgtaatccagggatattccatataattgatgctgatatccccggttacagtaaccccatcaggcagataatagacattaccgagaggactggccacgcagacatacccctgtgcgagcatgtcctctttttctttatcggtaaatcctaccgatatctccagacgcggaggggcacatcaactggtgattgtttcgatggaaagtatgatgttgcggaatccgcgtttattcatataggtaatagcattgtcgttcaggtgtaccatatgttcaattcctttcataatttaataatattacagcagtaattgtaaaacaaagtccacagatggaaagaatacctggtgtttcggcatagagtaccgctccgaataacatggcggcggcaggttcgctggaagcgagaatcgatgctttgccggcctccatatagcgcatggataaggaatatagtgcataaggcaggacggatgataccagcgcatgaataatcaggataaaaaaggtggtcctttgccctgagacaatcatactgcttaaagagtgtatattactgaaaggcagcatcgtcatgccggaaaagagtgtgccgtaaaaagtaatcgtcaggaaatgatatcctttttgtgtgacttttttgcttatgattccatatacagcatagaaaaagcttgccagaattccgcagagaattcctgttatgctccaggaaagtccattgctttccagtactccgcttaccagtacacagccaatgagtgcgagtgttacacaggtcagtttgtgtctggttatcggttcatggaagaatatagcagccagaaacagaacaaagaccggagacatggcaagtaacacggcagaaagtgcaagagatcctttcgtaacggaaatattataaaagacactgagggcggtcatgccgatcatgccgcttccgataaaaagccagaagtcacgccgatgtacataaaataaatgtcggttatagaatagaatccatatgccagtgatcagagctgcaagcaacatccggaaactaatgatggaaaagttgtcgagcccatcgtgttccagtgtacggacaaagattccggcagcaccccagcagatgccggagaaaaatggcagtaaccaggcgtatttggtaagtttctgattcataagtacccaatcctttgtaaatataataaattaagtatatcacaaaaacggacattgttatgagaacatgtccgttttgtgcatttttatgaatcactataatcgattggaattatctttcaaatgaatatattccgctacagaccggtcaaaagtcttgatatgttggaacagccagtctacaacattgcgctttacctgttcgataaactgatcatcaggcccttcattttcattcagataatcgtataattcctgaatagatgttttgaattcttcatgctttgcatggtgactggaaatctccggataagatacctttttctgaagttcctcttcttcctgaaaatgaaaatttgtatattcatcaaggtaatctaacattttgatcgctttgatcttactgtcaccggattcgcatgctgcaacgaactgccggatacggtcgatcagttcctgatgctgggaatcgatggtcttgttgcctgtaattaagttatcgtcaaatgtaatattcatagagaaacctcctgtctttggtacacattgaatcctcgtcccgcatagtctataatgaatcgtagaaaatgtttatcagcagagaaaaggattggattatgaagttacaacagttacagatatttcagaacctgacagaagaagaactggaaaaaagtcttgtctgttcacaggctgtagtaaagaaatatccgaaagatacctatattttccgtcagggtgatgtgccgttaaaattatatttcatattggaaggaatggttgagcttggcagtatcaacctgaatggtaagattacccggagcagttacgttacggtgggtgaggagtttggcgaagtagaaatgtttctgcgccagtctgcttactccggttatgcaaaagcaaaaagtgaagtgtcggttctggaggtttcacagaatttctttggcggaagatgcgaaagaaactgtgtacatcacagtaaggttgtcttcaatatgcttcagctttttgcggaaaaagcagagaaatgtaaccgtcagatagaggttcttaccagtggaaacttacgtcagcgtgtagcggcgtacctgttggaaaactgtaatccggactatcgggtccgtttgcatatgaacagggaagatctggcagtatatctgaatactacaagaccatctctgtcgcgtatgctgcttactttacaggatgaaggtatcatccgtcttgtaggccgtaaggtaatcgagatcacggattatgaaagactgcagtcggaagagtaattaatcttctgcaacaaatacttcttttcctaatccgcagattggacatacccagtcatctggaagatcttcaaaggctgtgcccggtgcgattccgttatccgggtctcctacagccggatcatattcatagccacatggttcacatacatattttttcatagttaaaatctccttttataaaaattaattgtttgttgattgttgctgtacaacttatgttgtgattaaagtatatcgcttttatcagagaaaatctgtaacaaatgttacgaaaatgagaaaaaatgataattatatgtcaattcaattaaaaatttccatatacatgaggaaatagaatgtttgaggaaaaattcgaaattttatattcttaatacaagaaagaaaatcgcggtttgaatctgagaaattattcatgcagaacatacagaaaggaaaaaaatagtatggaaacgaaagtgaaaaaaggatatggaaaaggatgggcattgattctttatgcattccttgcatattttacagcaactgcagtaggtagtgcaatgaacgcagcgtcaggaacgttgtctgaattaagaggatggaatgcagcattattaacaagctttatttcattaggatctattgcaaatgtagttgcaggatttgtttttggtaagttatcaacaaaagcttcagcgaaaaagctgagtatcatgtgtagtgtgatctggattgcagttgtagtcggaatgggagtgacaactaatctctgggcatttgcattctgcctgatcattgcaaatggtatttccagtgcgcttggatatcagctggcaccagttatgatttcaaaatggtttcctaagagaaaaggaattatcatgggaattgtaacaatgggtattccgctctgctcaggatttgcaacaatgatgtaccaggcaggatatgcagcaatgggatctttaggtggatttcttccatttattgcagtattggttgtagcgttgattgtactcgttgtattccttgcggatgatccggctgacaaaggattcaatccggataacggagcagaagcagaagcggaggaagaaaaaggaattaataaagaaagcatctggacaacacagaaacttctgtctactccacaggtatggattcatggtcttacacttggtgttcagttgttgttcgccagtggactgatggttcagttattcccaagacttctggagattggatttgatccaggaatggcaggaatgatgatgcttgcatctggtcttcttgctctgccaggctcttacttatgtggtgtgattgattctaagatcggagcaagaaaagcagcatatacttcatatgtattcggtattcttgcaatgcttctgaaccttacaggtaatacggtatgtgtatggatttcattggtatgtattggtatggttgtaggtggtgcagcaaactggccggcatcactctgtattgaagagtttggagacagcttcgcaaatggatatggtattatccagccaatgattcaggtagtcggagcagttggacctgcattcttcgcagcattttacggaatgacaggaagctataagataccatatatctgcggtgctgtattaatgtttatcggtctgattggatttgcgacactggcaaaaccaggatttgcaaaaaaagaagaagagaaatataaaaaataagggatgatatcagatgaagacatataaagtatttactgtaaatcccggttctacatcaacaaagatcgcagtgtttgatggagaaaagaaggtctactcagcaaatgtcagccatgattcaaaggtgttggaagaatataaaacactggaggatcagctggcttacagaaaagcaacaatagaaagtcttttgaaagaaaatcatatagacctggaaggtctggatgcctgcgttggtcgtggaggcggtctgcttgcaatggacggcggaacttatgaaatcgatgatcttgttttggaacattcgattcatgctaaaaacggagtagtacatccggcatgtctgggaccaagtattgcaagagaatttgcagagcagtatggtgcaaaagcatatgttgtcaatccgccggatgtagatgaactgcaggatttggcgcgtatgaccggcatcaaaggtgtatatagaaatgtacatcttcacgcattgaatttaaaagagacagctatccgtcatgccagaaatatgggaaagaaatatgaagagtgtaactttgtagtctgccatatcggaggaggtatctcggtatcggcgcatcagaaagggaaaatgattgacggatttgacattgtcggtggagaaggaccgatggcacctaccagatgtggaagtgttgcagtggcagatgtgttgaagtattgtgaagacaaagagattaagactgtgaaacagttatgcacgaaaaatggaggatttgtcaatcatatgggaatttcagatgcactggaactgacaaaatgtgcagcagatggagataaatatgccggattactctgggataccatgatctatcagatcgcaaaatgcatcggttctatggcagtcgtgctggaaggaagtgtagacggtattctgttgggaggtggaatggtctacaatgaagatttggttgcgaagcttaaagggtattgcgaatggattgcgccgataagtgcatatcctggggaatttgaaatggaagcaatggcatccggcgcagaacgtgtgttagatggcgaggaagaagtgaagaaatatacgggagaatgtagatttcagggatttgattttataaaataatggcgatggaaaagggtgccgcacagataaaaatgtgcggcaccctttttgtaagctgacattcgtccgaaagaaactgcgagtggcaggttttgcagataccaaagtatgtaaaaggaactgacggcagcaaatcctctgcattactcatatgctttaaagaaatcaataatttcctttttagtctttagcatccgcagagtgtcaatgtcaagcttgtcattataaaaaatatgcagaagccggaacaccagagtcgcatcatccggacggaaagctcccataataatgatacggatcttataggaattccacatgatccggtgatccagtgttgtgattgataatcgtgtttcctttgcgggaatcagagaatgcaagaacagaatcccgggaccagtcgcattagtggcgatagattcccatcttaaaatatcagacagataagacgtatcggtcaggttattctgtaaaaaatcttcagccattgtctcaataatggtgaatctgtcggtgaatgattctttttcatgccagaatgcatgctccagcaaatgaccgagtgttatatcagatgcggcgcataaatgttcgatacgctgctcgttgatgtattctgacagaagcagatagtcatccggtgcgagaaatgggctgatctgtatggtatcaataccgggaaaattagtaattgatttacggacggttgataagataagatctgtattttgaaaatcataaatattcttatcattcacaggcaaaagtgccgttacattcaagtatttatcaaaagctcccagaattttccgcttaagtgcccaggcagccggcatattcatgtggcagaagatgaccgttttcatcttggtctcaggatgtatctcaaacaggaattccacagcacctgagatgcagtgagccagatagagcagttcattctgattcaggtaatatccaaggtattgctgggcgagatcctgaaacaggtatgcaatctcgaattctacattcaggattcgtttttcaagatcctgatttccctgtgtattgagaatgtgtgtaggagcctggatgaactggatgtaggataaaagcgtgatatagaaatcctcatcttcagaaaaatccagatggaatacatcctgaattctgtctatgtaagctttcgctagctggatggtaaccggaccaaaatgctgtgagatattcaatggtgtaatgtcggatacatcaggaagatgtccggaggcaatccgctgataaagatcatcccgttcttcgcggctgaaagagcaatggaactgtccttccagggcatctgccagactgtcggaagccaggctggccggagtatcaggccggagtacaggtgaagccggtggcagctgatggccggataatactcggtgatacatgatagcagcagcaagattcaaagagacaaggcttgggtcttccatagatattccgtatttatccagatgtaagggtacttcatccataatgtaatccagcacgtctttattcagaaatgtatatccgtaatacgtgttccagttgtgattataattccagtcttcatgaaataaccggttcagaacagagcgacgtttttgttcattttcttcgaatgtaagaaagtttcgcttctgttctaattttatatagggttccgacaatacatatttcattttgagactatgcagatcgtgttccagtgttgtgtggcttatgaacatttcatcttccagatcaaagagatttagatgttcatcggtcagacacagccggaaagcaagataacggatgcgatcttctttggtaaagaatgcagtgtcaatttgatttagctgttggatgatttcggggttttctgcggtataaaggtatcctttgctgcgcgcggaaagaatctttgcgtgatagggtaagatgttttgattgatttctacgatatcactgcggatcgttcgtggtgaaacacctaattgctttgcaagttcatttccggtgatataagtagtctgttcctgcatcatgtggagaagtttccgttggcgcagagatagattaagcttgtccatgataaccgtcctttcgtatatttttctgagtatattttatcaaaaagcattgccgttttaaagaggaaatatccaatttgagaaggcggaggaatgagattaagataaagttataaaaaacaggaggtcttaaagatgaaatacgaaaataccagaaaaattgttttagatgctattttagatgcagtagatatggggctgatccatggaacatcaggaaatattgccatgagagatgataaggaagatgtagttgcgatcacaccaagcggaatctcttataaagggatgacagcagatcagattgccatcgtagatatgaatggaaaatggcttgatggaccattcaaaccatcttcagaagtcccaatgcatacagcagttatgagagcaagaaaagatgtaaaagcaacggtacacacacacggaatgtttgcaacaatcgcagcaatgagcggagaattacttccaattacaccaccgcaggcagaattcgttccggtaggaattgttccatttacgatgccgggaagtaacgatgttgcggataaagtagttgaggctcttggagaagaaggaagagcagtcctgatcaaaaatcacggaatgttctgctgtgggaaagatatgaaagcagcaatggcagcaacaatttatacagaagagatggctcagacaacatactatgcaaaggttgcaggtgtatatcagccgatgccggaagaagctgttaagaaaatgaaagaactgatcgcagcagaccaggcagtgtaggaggaagaaaatgagttttaactttttcgtaaaaagcaatattacattcggaagaggtgcagtagagaaacttccggagattattgcaggatatggattgaaaaatatcatggttgtgtatgaccgaggagtaaaggcagcgggaattgcagaacgtgtgatggagcaggtaaagaaagccggagtaaaagcagttgtgtttgatggagtcattccaaacccgaccaatgaagtggtagaagaagcagcagcaattgcaaaggaagcacaggtggacggattcgtagcagccggtggcggaagcagtattgaccttgcaaaagcaatcaatgttctgatgacaaacccaggaaagattggtgaatacggcggaataggaatggtaaaaaatgcatgccttccactgattgctatcccgacaacagcaggtacatccagcgagatcacaaatgtaagtgcactgatcgatacagagaaagtaatcaaatatgtagtcattgacaacaagatcgtggcatctgacgttattgcagatccagatttcacaaagacagtaccggcaggcgtaactgctgcaaccggaatggatgcaatcacacatgcagtggaaagctacatttccaatatggcaacaccattaacagaatacaactcattaaaaggactggaaatcttacataagaaccttccgaaagttgtaaaagatggttcggatatggatgccagagaacagatgatgctgggatgtatcattacagggttcggattctccaatgccaatctcggactggttcacggtattgcacatacactgagtgcacatttcggactggctcatggaatggccaatgcaaccgtacttccttatgttatggaatacaatgcaggcagctgcccggaaaaaatggttgatcttgcaaaagcaattaaacttccggtaacaggtaatctggatgaggacaaactgcttcttgcaaaagaattgaagcgtctgacaacagaacttggaatcaagactctggaagagcagggaataaaaaaagaagacttcgatatgctggcagatgatgtgttaaaagagcctgtgcttggattcaacccacgtcagaacatcacaaaagaagatatccttgcaattcttgaaaaggcattttaatcagaaaggattaacgataaggtgagtaaaggaaagaagataaaaattattatttcaattgcagcgatctcgttcatccagggattacaatattgcgtatcgcctgtgcttgggcagatacaggaacattatccggatgtcaatatcagtctggtccagatgctgattacagcaccggcgctgctgtccatgatcgtggcagtattgtccggatggctggtcttaaagatcagcaagaagaaattacttttgtttgccagccttgtagcaggaatcaccgggttccttccgtatctgtcggatagttttggtcttctgttcttttcacgaacattttacggtgtaggactgggacttgcaacggctctgaatacggcagttgtggcagagttctttgaaggagacgagcgggtgtccgttatgggaattcaggcggcgagcgtaggtgcaggtatggttgttgtaacaaccgtcggaggaatgctgggtgccggaggatttaaaaatgcatatctaatcaatgtgatcggctttatttctctgatattgattgcatgctgccttccggataccggaaaagcgcaggcttccggctcggaaaaaattcagctgaacaaagaagtttttaagatctcatttctgggaatgcttgaatttttattcctgattacatttacaacgaatatagccatgcatctgagcggaaatctggcaggaaatacagccgtttccggaaatctgacgggcgtattttccggatcccagattgtaatcggattaatccttggtatggttacaaagattacgaagaagtatacacttccagtggcgatgttaagtttcagtatcggtggactgttactgatcctgtttccgtcgaacctgatcatgctgatggcaggagcagtgttctgtggattttctcagggcatcttcattccacaggcgatggtggatgtcgcaggggctgtaaaaccagtggcaacagcgatggcatctgcatgttttacctgtgcaatgtgtttcggtcaggtaatatcgccaacggttctgaataccatctcgaagctggtattcggcgaagtttccactacgaatgtatacatcatttccgtgattggaatgacagtagttgcagttatcacaattattatgaaaagaagaaaggaaaatatataaaatgaaaaagacattagcactttgtactccaattccggagaaacagatggagtatatcaaagaacagtgtgacattacaatctgcggtgagttaaaacacggaaaaggaaatgtcacagaagaaatgacaaaagaagaatgtatgggacatgaactggttgtattaggagacgaatatgcaggcgcagatacgattaaggcatgggcagagtctggcatgaagttcatgggagttgccaagggaacacccgcaaccgtagatcacaatgcgatcaaagaagcaggtctggaattatcttatacacctggaagaaaccgtgttgcagttgcagaatttacaatcggacttatgatcgcagttgcaagaaaactgacattgagttgtacaggattatccaagggagaacatgtaggagaacctatggaagacatttatgacgtaccggatgtaaagaatgttacatttggacctctggatgagaagcatccatttgtagattacggaatcggatttgaattatacggaaagaaacttggtgttgcaggatatggtgcgatcggacgtgaagtagccgtaagagcaaaagcattcggaatggaaatccttgcatatgatccatacatgccggcagagaagatcgaagcagacggagcaagagctgttgatctggacactatgcttgcagaaagcgacatgatcagcatccatctcccggttcttccatctacaaaggggattgtaaataaagactggttctctaagatgaagccaactgcttatgtgatcaacacagccagagcagccgttattgatcagaaagatttcgtagaagcacttatgaacaagacaatcgcaggtgcagctgttgatgtgtactggaaagagccggtaccggcaaatcatccactgttatctatgcgtaatgtagtatgtacacctcacatggcaggacttacaacagacgtagataactggtcaggtacgatgatgggagaagagattactgcttacctgaaaggtgaaccaagaaaatatatatggaaagtaaaaaaataaaaatcagaaacaaggaataaaggaaatgtaatgggctgttcttcagcccattttcaaaaggaggatctatatgggagccaaatgttgtaaaggaaaagaaaaatacccgcatttgttttcgccaatcagaatcggtaacatccgattaaaaaaccgtattatcgcagcaccgacaagtcctagtatgattacgacagaaggacactttacaccggaaatgactgcttatttggaagagaaagctaaaggaggagttgctgttgtaacgtatggggaatcaatcgtacattctgcgacaggaaaatctcataacaaacagttacagttagattcattcggagtcaaacagggaatggcacagactgcacgtgcgatccacaatgccggagcttatgccaatatccagctgtcacacggtggaaaatacggcggactcgtcagcgtaggcggtgaccaggatggctgtgaagttgcatatggtccaagccatgagatgacaccagccggggaagtacaggagatgccgaaagagctgatcctggagatcgtggaatcttataagacaggagcaaaactgtgcaaagactgtggattcgatatggtacaggtacatgcagcacacggatggctgttctcacagttcctttcacctgtgatgaatcagagaacggatgaattcggaggctctcttgagaaccgtgcaagattccttatgatggcactggatgcagtcagagaaggtgtcggaccaagatttccgatcgagattcgtatctcaggagatgacctgacagatgtcggactgggactggaagactgtgtaaaagttgcaaaaatggtagaggataaagtagatctctttaatgtatcctgtggaaaccatgaagatcctgccatgttctgtcgtacccatccatccgcattcttcaagcgtggcgtgaatgtatatctggcagccgagatcaaaaaaaatgtaagcaagccggtagcctgtgtcggatcgttaaatgaccctgcacagatggaagagatcattgcaaccggacaggcagatatcgtagagatcggaagagcactgcttgcagacccatatcttgccaagaaagcactggaaggaaatgcagaagatatcacaccatgcctgagatgttatgaatgtttcggagagacttccaagagtgagactgtaaaatgtacagtaaatccaactatgggacagcagtatccggagaagacaagaaagcagaccgcagacacgaagaagcgtgtcctgatcgcaggcggaggtccggccggaatggaagcagcgatcacggcagctttaagaggccacgatgtaacactggtagaaaagagcggcgaacttggcggtaatctgcatccggcaggagcggcatattttaaagaagatatccgtaaattatgtaaggtcctgatcagccgtgtagaaaaagcaggtgtgaaagtagttctgaatacagaggtcacaccggagtatgtagaaacatttgacccggatgcattatttgtggcaattggatcgaatgaactgcgcccgccgattaaaggtatggatctgccacatgtgataatggcgatcgatgcagagcttcatcctgaaaaattaggaaagaaagttgcaatcatgggaggcggacttgtcggaggagaagctgcagtatccttccaccatgaaggcaaagaatgttcgatcattgagatgaagagtaagattgcaggagaagtgaattcgttctacagaggaggtctgatgccggagatcgagaaagcagccacatgctatgccgatactaaggtaaaagagatcgttccagagggagtactttgtgagaaagacggaaaagaattcgtaatagaagcagattctgttgtatgtgcactcggattccgggcaccatacgacaaagtcgatgcattatgcgataaagtggatgaatattatatcatcggtgactgcaagaacgtcggacagatctatcacgcaaccaatcaggcttattacgcagcaatgcgtctgtaaaaaaggagggaaaatggatggagaagctgaatattctgcttatcaccggaattgtaacagatgaacacactccgcttatgaacccgatgatccgctatatgttggaatcaacagagagatttaaagttaaaattacggaggaatttacggggtgtactgctgagacactgaaaaaatacgatgcagtatttattaattatgatggcaaggaatccattgagacaccgtttgtgaactggggaaagacagcagaagaggcactttatgaatatgtaaagaatggcggcggatgtgttctcttacatactgcaattatgaaccctacaggacgtgtacacgatgatgaatatgtaaagcttgtcggattcgattttgaactgaagggggctgccggcgatattaacggcgttcgtaagaatccggcattggagtatgtcattcatacgcaccgggatgcgcatgaaatcgtggctgtaaaccaggaaagctggatgacggttcaggaagacgtatttgcgaatgcaaaacaggtggatccggacattacggtactggcatcggtgacagacagactggaagactatgatcttaataagatgcaggatcatgtggcagccgtttataaaggattcgatatgagcaaacttccgggcatcaatgaggaagtaccggtggtatggacacacaactatggaaaaggacgtgtattcgtatgcgcaatctgccatggcccggacacgttatgccgtccgaatatgacttctatgctttgtcgaggtaccgaatgggctgcttcaggagaagtcacgattccatatccagatattcaaggtgaacgacgcaagaatgcatggccgttctacaacaatattacatggtctcagatgggtgagattaaaaaatggtaaccttttaaaattttattttcttttgtgggacaggtatggcttttgctgtacctgtttttttgagttaaattatattgccgtaataaagcggaaattatgaaattgtcttctgcacaagaaatatctatactgaatttaacaaataaagcatgaacatttgaagcagtgcttcgtccatggaataaaaatgcaatacaaggaggatacagtgatgaacagagaggaacttttagcaaaaattattgaattcgcagcaatggcattcaacaaagatgcagctacaatcaatgagaacacaaatatctcagaagaattaggggtggcatcttcacaacgtgtagcaatgagtgcttccattgagaatgatttcgatgtcatgattccggttgcaagatttggaaaatttgaaactatcggagatcttgttgattttgtaatggatgagatgtaaggaggaaattatggtacacaatgtaaaacttggaaaaaatatgagaagtgtatcgattgttggaatcggtgcaacaccattttttaatggcgtacagaatgaaacatacaaaggacttacgaacggggaactctttggacatgctgcactggatgcaatgaaagatgctggagtagagccaagagatgtgcagtacttcttccacggatctgcaaacccgcacgtgctgaacaactgtattacaccgaaccttcaggtggcagactggtttggaatgagaggaaaaggatcattatctcattcggaaggttgctgtaccggttacattgcactggaggaagcagtattcgcagtcgccagtggagcgtatgatgttgtgcttacaggatgcagcgaacagggaacaggaatgccagatggaaacacaccggatcatatgcgtgttccacttacttcagaagtattattcccggatctggattccatctttgaccgtgcttatggaagataccttggaggtggtcctggtatgaaccatgatgactggatcaactattatgcaaaagaaaatggactgacaccggaacagattgatgacgttcttgcacatcaggcatatcatttccgtcgtgcggcagaactgtgcccgagagcaatccgacgtacaccatttgaccagatggcaaaagaggctggatatgatgatgtatgggaatatatgagatccagtcataacccgaagatgacacagtacttaagaactgcaagtgattcctgtgttgctgacggagctgcggcatgtatcgtcgttccgacagagattgctcataagtttacagataagccaatcgaagtattagcagttggagcatctgtactggatgcaatcgttccacatcttgaaaagaaagcaactgcagaagcagcacgtcaggtatttgaggcaacaggtctgacagctgacgatatggatcttgttatggtcaacgattttatcggatcttctgcattccttgcagctgaagagattggatatcttccgaaaggagaaggatggaagtatgttcttgacggaagaatcgcttatgatggagacaaaccaatgaatacgaacggaggaagaacttcttacggacatgcattcggtgcatccggaatggcagacatctttgaagcagttactcagatgcgtggagaagccggagaacgtcaggttaagaaacttccgaaatataccttccttagaggatttggtggagcgcagaacgttcgtgcaattattttgaaatctaatttttaaggaggtataaagatgagtccagagagaatgaaaacagaagaattttggaatccggaacatattgttgagaagttctggaatggattaaaagatggtgtgatatacggaagaaaatgtaaggaatgtggagcaatcgaatttcctcctcatcttgcatgtaatagctgcggatatcatgaaacagagtggacaacactgaccggaaagggagagttaaaaagctttgtgttcacaggtgttctgaatgcaagactggaactggaagaccgtggtctgaaatatgtatgcggtgaagtccagttagatgaaggacctgccattaatgctgttattcttggtgtaaacaagaagaaagcaagagagattgatggaaaacttccggtacgtgtccgcccggtattttacgatatgggaagatatacgacgttattttttgaattagatgagtaatacaggacaacagtaacagtatggaggaaaattccatgaacgtattagaacagatttatgcgaaagcaaaagaaaatccacagaaagtggcttttccggaggcttcgaatgagaaaatgatgcaggccgcttatgaaactggaaaagaaggatacatcattccggttcttgtgggggaagcagagaaactgaaagaacttgctgaagaaagaggctatgatccatcggtatttagttttgtagatattcatgatgagacatacacaaatgatgtgatcagaagatatgtagaacttccggatacaatttttaaagagaaggcaattggaagacgtatgcaggatccactgtattatgcaatggcaatgcagaaagtcggcgatgcagatgttacatttgccggaatcgataacacaactggtgatgtactgctcgcaggtcagatgatcattggaatgaagccgggaatcagtacaatttcaagtatcggactggcagatataccaggatatgaaggcagtgaaggctctcttctggctgtcggtgacagtgcagtgtgtacaaacccggatgctgagcagttggcaagcatcgcaatatcagcgtgtgacacggtgcaggaacttcttggctgggagccgagatgtgcgatggtatgttattctacacttggaagtggtcagggagaactgattgataaagtgacggaagctctgaaaattgcaaatgaacttcgtccggaactggcaattgatggagagtttcaattagatgcagctatcgttccggcggtagcggaaaagaaagtaaagcgcgaaagtaaagtagccggtaaagctaatattctgatctggcctgatctgaatgttggaaacacagcagtaaagctaatccaacagtttggtcatgcgaatgcatatggaccgatgctccagggatttaacagtattgtatgtgactgctcaagaggagcaccggtaagtgaaatcaaaggaaacgttgttatctcggcggtacgtgctgctgagagcaagaaacgagtttaacagaaggttcaggaccttcgtagcaaacagataaaatgtgcccatgatttaagttcgtttgataacataagatagccggatctgaacaggagacggacaatgtaccttgtacattggaaaacgtaaaagaaaaatctgtcagatccgtatcaactccaattccatattttttaacgtaggcttccttcaatgtccacaggcggtaaaaccattcccgattctcggaaaggtctgcattgtgggactgaaggaagtctttttcagattcggagagtgcacggtcaactaagacatccggataatatccgggaaattcagcatcgatcccgatcggacggtcatgaaagacgcaggcagcgagctggtcacagtgtgtaatgttaaaacaaatttccgggtggtctggcaggtatggtttgccattagcgtcggttttcagggcctgttccagttcttccggtgaaaaggaaagctggaaaagatcctgcaatccctgaagcagaagcgtatgtccaaggttgtgttcctgtgagctgatagcggaaatggagtcagaaataggtgtataataagcgtaatagatagttggcataagtgtttcctttctgatttagaaatcaaaattcaaataatacaacgataaatcttttgtatattataacccgtcggagaaagaaaatatagtgaaatcaggtgaaagagtatgatcttaaaaagagagtttggagaattatattatgaagttcgcggagagggaaagcctcttcttcttatacatggtgtgattgtggatgcaagtctgtatgaacagacggcagagatattatccaggtattataaagtgatctgttatgatcggagaggatattccagaagtaaatgtaaaaaaactccggaatttcgcatggaagatcaggtaaaggacattttggatattctaaacgagttgaaaatagatcggatcattgtaacaggtgcaagtgccggagcggtagtgggacaatattttttacagaaatatccagaaaaagtagaatatttactcatgtatgaacctgcgatgttaggaaacatgatgcaggaagaggagacatttaaaaactgggcagaagaaacagaagaattgatcagaaagcgaaagtataatatggcattactgcgtttttctaaacatatagggtatcaggatccaagaagtcctcaaaagtcagaagaggtatcgttgcgggaactggataatgtagagtatgcattcaataaagagattcctgtacttttaagatattatccagatatagataagatgaaccaacatgctgataagattacgattgcagcaggagaaaagagcgaagattctgtgtatgtgcaggcagcaatccggctggccgcgcaaataggaaagaaggttgtctattacccgggagggcataatcttccgtatgatcttccgttagagtttgcaatttgtgtaatagggacacttgctatagtgaaaaaataatctttctttttatttccgtttatatatggcaaatatgcttttgtgacaaatacagaagtctgctatcgttaaatcaacatagaaaagataggcggagggtttttttagatgtcaaaagtagaaagttatttgttgggcatggattgcggaacaacgaacttaaaagcaattatattaggagaagatggaacagttgttgcggaggcaagcagaccaagtacctttatggatctgaagtctgatatgcgggaacaggatgcaaatgaatggtggagtaatacagtagagattttcaaaagccttgtagaacaggcgggacatgatattgtaaagagaatcagaggtatttccatcagttcacatacagttaccatgcttccggtggatgcagagggaaatcccctgagaaatgggattacatgtcaggacagccgttctatagaggaattgcattatattgtagagacaataggttatgacaggtttgtgaaaattgtaggtggacggcctgcagttgcatttcttccaaataagattctatggtttaaaaagcatgaaccggaattatttgcaaagacagtgtgtttccttcaggcaagttcctttattaattacaagctgactgcgaagatgacgatggatatcgatcaagcgaccagaacacagtgcatggatatcagcacgatggaatggtccaaagagataggggatgttattggagtggatttggatgcaatgtttccaaagccgagactggtagatgaaatcatcggatttgtaacagaagaagcggcagaagaaacaggactggaagaagggataccggtcattgcaggctgcagtgatgccatggcatcaatgcatgcaacaggcatgagccgtctcggagaagcaggagaatcgtcaggaaccacatcacttgtatttgtgggaagtgatacgaagagtgcaccagatattccggttgtcacaaagccatgtactattgatggaatgccatggatctttgatgcaccgatccaagcaactggtgcatcattaaaatggtttattgaaaaaatggcagcagaagaagttgcatatgcaaaagagcatgatcttaatatctatacttatctgaatgaacttgctctggaatcaaagccgggggccggcggcttattcttcttcccatatctgctgggagaacgggcaccgctctggaatgagtatgcaagaggtatgttcattggaatgggcatggatatgaagagaagcgatctggtccgtgcggtatttgaaggaacggcttttgcactcagacatgtcatggagacggtgaaagaagccggagcgacagcagaattgctgcgtatctgcggaggcggagccaagagccgtacatggtgtcagattaaagcttctatgttgaatatgccggtatatgtgatggatgacaagtcgggagacgttccggtaggagatgcactaatcgtcggacataagctgggtgtgttcccagaacttacaaaagcagctgagaagatcgtaaaagtcaacgagattatcgaacctgttgaagaatgggtagaagcctatgacaaactgtacccatactatgtagaaatgtataagcatctggatacagatctgaaatctctgaaaaatacagtcgatcaattataataatgtgaaaataaaactgccggtatagaaaaagtgtaccggcagtttatatgtcttaagtattcttaactatgcgccacactttactcactgtaaaatcaaaaatgcaacaaatttcgtaaaaaaatatcaccaaaatttagactgtattccaaacatttattttaacaaaattacctctttcctttttgcctgttatagagtatcatattacttgcacaacatcttgtgcagaaaagatgttaaaaaaacaatatttagtagtatttgagggtgagcacatactacatcggcaataaaaataagagagggatagacatgaacgcagaaataaagacgaacgtaattaagagaaacggcgaagaggtagccttcgacctggagaagatcattaatgcgatcaagggtgcaaacaaggacgtcgacaaactgcatcggatgaatgaatatcagatcatggcagtggcggacaacgttgcaaagaaaattgaggaatccactcatgctgtcaatgtagaagatatacaggatatggtagagaccggaattatggaactgcgcggctatgaagtcgcacagaaatatgtgcgctatcgttataaaagagaactgatgagaaagacgaatacaacagataacggaattcttgcacttctggagcatatgaatgaagaggtgaatcaggagaactctaacaagaatcctgtgatcaactctacacagcgtgattatatggccggagaagtaagtaaggacttgtcaagacgtgtccttcttccggaagaggttgtacgtgcgcatgaagcgggaatcattcatttccatgattccgactatttcgcacagaaagagcataactgtgacctgatcaatcttcaggatatgcttcagaatggaactgtcattagtgagaccatgatcgagaagccgcacagcttctttacagcatgtaatgtaacgacacagatcgttgcacaggtagcaagtaaccagtacggcggacagtcatttacactggcacatctggcaccgtttgtcgatatcagccgtaagaagatccgcagaaatgtaatcgcagagcgtgaagaatgcggagaagctttagatgagacaattatcaataaggtgacagagcgccgtttaagagaagaagtaaagagtggtatccagacaattcagtatcagcttatcacattaatgacatgtaacggtcaggcaccatttgtgacgatgttcatgtatctggatgaggtagaagaaggcagaacccgtgatgacctggctatgatcattgaagaagtgatgattcagagaatgcagggagtaaagaatgaaaaaggtgtatggatcacaccggcattcccgaaactgatctatgtactggatgaggataatattacagaagattccaaatactggcatctgacagaactggcagcaaaatgtaccgcaaaacgtatggtaccggactacatctcagccaaaatcatgaaagagatgaagaatggagaagtatatccttgtatgggctgccgttcattccttactgtagaagacagccagagaaatccggacggaagccataagttctatggacgttttaaccagggagttgtaacgatcaacttagttgatgttgcatgttcatcagaaggagatatggagaaattctggaagatcctggatgagcgtctggaattatgtcacagagcactgagatgcagacatgaacgtctccagggaacggtttccgatgttgctccgattctgtggcagaacggtgcacttgcaagactgaagaagggtgagacgatcgataaattattatttaatggttactccactatttcgcttggatatgcaggactttatgagatgtgtgtacgtatgcttggcaaatcacataccgatcccgcagcaagaccatttgcaatgcaggtaatgcagaagttaaatgataaatgtgaagagtggaaaaaagcagagaacatcagctattctgtatacggaacaccgatggaatctaccacatacaaatttgcaaaatgtctgcagaagcgttttggaatcatcaagggtgtaacagataagaattatattacgaacagctatcatgtacatgtatcagagaagattgatgcattcaagaagctgaagttcgaagccgatttccagaagctttcaccgggtggagcaatcagttacatcgaagtaccgaatatgcagaacaatattccggcagtactttctgttatgcagtatatttacaataacattatgtatgcagagctgaatacaaagagtgattactgtgaatgctgtggttatgacggagagatccagatcaaggaagatgaaacaggaaagctgatctgggaatgcccgaattgtggtaaccagaatcaggataagttattcgtggcaagaagaacctgtggatatatcggaacacagttctggaatcagggacgtacgcaggaaatcaaggacagagtattgcatctgtaacataaatgaagatatgtccaggttatattaacttgtgatgttgataaagattatagcaggagtatatcgaaagatatgctccttttctaatttgtctattcttcgtgtttaaacatgaatcaaaatagtatataattaatagatatcaaaaaggagactttacaaatcatgaattacggaaatataaaagaatgcgacatcgcagacggaccgggcgtcagagtcagcctgtttgtatccggctgcaggcatcactgcaagggatgttttaatgaggagacctggaatttcaactatggacagccatacacagaagagacggaagcggaaatattgaattcgctggattctaacttcattcaaggattcactttgctcggaggggaaccgttcgagccggagaatcaggtggaactggtaaagcttttaaagaaagtaagagaaacatatccaaagaaagatatctggtgttacagtgggtatctttttgaccgagatatgatcccgggaggctgtgtgcatacgaatgtaactgacgaaatgctgtcttatatcgatgtgctggtagacggggagtttaaggaagcattaaaggatgtgacactggtgttccggggaagccaaaatcagaggattattaatgtgaaagaaagtaagaaacaaggaaaagttgtacttgaagattattgatactggtgatgagaatataaagtatcgtgcaatgaaaaatattatatagaagaaagatcataaagatgtattattgctatgcaggaaataaaaaagcaggagattatttctcctgccagatgcgtaacatcttgatgatcttttctttttccgcaactgaaaaaccacggaatacattgagcacttcgtcatttaactggcgctctttttcatccagaggaggaagatctcttcccgcatccagaatcgtgtccacggatacgttacaaagctttgagtaataaagaagaactcttaagttaagcttagcacgattgttctcgacattgctgacgaaaggaacagtacagttcagatcttttgctacctgttcctgagtgataccgcgttcacttcttaattgtttcatttttaatccgacttttgaaaaatctacttcgttcattgctgggctcctttgaattgtaatgtataacgatattatataagtatatattattataaatcttgccaataatcaatacagaaaaatttacttttccttaaaaaaatagtataattaaaataacttatacaaaagacaggatgataagactaaaaaggaggcaaaaaatatgttgacatgtatttatgtagttgagaagattgatggtgactatgcggaactgagacgtgtggatgcgcttgcacaggatcaggaagaaaacaaggtgatggcaagagcactacttccggctgatattatggaaggaaacaaaattctatatgagaatttacagtaccgtctgatcacagagtaagatcagggcggatatatcaattttgaatgagcgtacatataaaattgagatatacaacaaaataatgaaaagtaagaagtgtaacagtataaaagcggttacactttttttgcgcccaaaacaatagacaatcttgaaaaaatgtcgtatttcacaaagaaaacgagaggattttctcaagaagaaaatcgaagaaatcgctgttttgtagaaaaagaagggaattgaaaaataaaaattgtgcattttccttgtgaaaaaataaaaggaaattggaactaccatttcggtgcggaaatttgatgagaaaaataaaaaaattaagagaaataaaagtaaaaatacacaaaaaaataatgaaaaattatgcaaaatagacagcggacaaaacgattgacattttcaaaaaatagcagtaaactagcaaaaaaattatgaaggaaggggatagtacggaaaagcttgttgaaagccttgtagaagaacttaactgtgaaaccgtatttaccatcccggtatttggaggaatcgctgttgacgaaggtgttgttgtaacttggatcattatggcggttcttactattctaagtatagtattcgtaaggaatctaagcgtagagaaaccgggaaaggtacagcttatgctggaatcagtaattggctgggcacaggatttctttgaaggtattataggaaaagaaaacaggggatatattccatatctgatgacggtagcgctttatcttgcaatatcaaatgtcatcgggctgttaggatttaagcctccgacaaaggacatgaacgtaacaatcgcacttgccgttatgagtatgttcgtgatcgagtggtccggtatccatagaaatggtctggttcactggtgcaaacattttgcaaagccagtgccgatcgtagcaccaatcatgatactggagatcgtaatccgtccactgtcgctttgtatgcgattgtttggtaatatgttaggcgggtttgtagtcatggaactgatcaaacaggtcgttcctttaattgtgccgataccgtttagtttttattttgatatatttgacggattattacaggcatatgtattcgtattcttaactgcattatttatgacagaagagatggaataaggcgaatcagacatttacaacatttagtataagaaaacgtaagacaagaaaaggagaacaaattatgagtggaacaattatcgcaattggagcaggtatcgcagtacttacaggtatcggagccggtgttggtatcggaatcgcaacaagcaaagcagtagacgctatcgcaagacagccggaagcagacggaaagatcagaacatccctgatccttggttgtgcacttgcagaggcaaccgctatctacggtttcattattgcacttctgatcgtccttcttttgaaataatgtttgctgacgataacagattaaaagaagggaaaggcaggtagagatatatgctgagaatagattttaatctagtgctgacgatcatcaacctgattgttctgtatctgattctcagaaagttcctgtttcgcccggtcatggacattatggaaaagcgggaaaagatgattgcagacggaatcggccacgcgaatgaggagcaggacaaagcgcatgctctgaagaaacagtatgaagatgcattgaatggagcaaaagaagaatccacaaagatgatcgaacaggcgaaactggatgcaaaacaggaatacaaccagatcctgaacgaggctaacgagaaagcagacaaggttatgaagacagcaagagaaagcctgaatcaggaaagagaacaggcctttgatgatatgaaggcacaggttgcagggctggcaatggatgctgcgaagaagatattacttgagaatgctgacaacataagcggcgtggatgcatatgaccagtttttgaaagatgcaggtgattcccatgacagcgaagaatagaaaagaagcagagccggtattctgccaggtggcagccctccggtatgcgaaagttctgaatgaacttggtatttcgaaagaagctgtcctggaggcaggaaatattttcgaaaaatcacaggaattgaaagcagcactggttaatccagtgatcacaaaagagacaaaacacaatatcattgataaagtattttcagaagaaatgagaacatttctgaaggttgtctgcgatcatgaaaagatgacgatcgcagaacagatctttgcagcatacgaagaattacagaatcaggcagcaggagttaagacagtctatcttcgttatacagcgcttccaagtgaagaacaaaagaagcagatgggtgactttatcaagaagaaatacggtgccggagacatcaaatgggttatggcagaagacaaggcactgatcggcggatttatcctgcaggttgacggaaaagaatatgactacagtgtgcagggccgtctgaaccgtttacagcggaaattaacaaattaacatggaggtgaaggaattgagtgcaatcagctcagatgaaattatctctatattaaaagaagagataaagaattatgacgtaataagcagagatcaggaagttggtactgtcatctctgttggtgatggaatcgcctccgtatacggaatcgaccacgcaatgtatggcgagatcgtcacattggagacaggtcttaagggcatggtacaggacatcaaggaaaacgagatcagttgtatcctgttcggagatgattcagagatcaaacagggcacaaaagtgtgccgtacaggtaaaaaagcaggtattccggtaggagagggttatatcggaaggatcgtagatgctcttggagcaccgatcgatggaaaaggtgagatcaaagcagacggatatcgtccggtagagaatgaggcacctggaatcgttgaacgtaagtcggtaagcgttccacttgaaacaggtatcctttctattgattccatgttcccaatcggacgcggacagagagagttgatcatcggtgacaggcagaccggtaagacatctattgcaaccgatacgatcatcaaccagaaaggaaaagatgtcatctgtatctatgtagccatcggacagaaagcatcaacggtagcaagacttgtaaatgatttaaaagcacatgacgcactggattacaccacagtattctgctcaacagccagtgagtgtgcgccacttcagtatattgtaccgtattcggcaacagcacttgcagagtatttcatgtatcagggaaaagatgtattgatcgtatatgatgatctttctaaacatgcagtagcttaccgtgccatttctctgctgcttggacgttcgcctggacgagaagcttatcctggtgatgtattctacttacattcaagactgcttgaacgaagcagccgcttgagcgaggaagcaggcggaggttctatcacagcacttccgatcattgagacacaggcaggagatgtatctgcatacattcctacgaatgttatctctatcacagacggacagatcttcttagagagtgacctgttcaatgcaggtatgcgtccggccgttaacgttggtctttctgtatcccgtgtaggtggagccgcacagacaaaggcaatgaagaaagccagtggtagtgtccgtatcgacctggcacaggcaagagagatggaatcatttacccagttcagttcagaccttgacgatgcaacaaagaatcagctgaaatacggaagctgtctgacagaactgttaaaacagcctctgggacgtccgttaagtcttcatgagcaggtgatcacactttgtgtcgctacgaataaactgatgcttgatattgacacaaagaagatcaaagaattccagatggatatgcttgcattcttcgacagagaacataaagaaatcggcaaagcaatcgatgagaagaaagttctggatgatgaactgaaagagcagattcttgcagcagcaaaggaattcaaggaaagaagataagcgggtgtagctatggcaaatgcaaaagagattaaggaaagaatggccagcatcgaagagacgagaaagataacaaatgccatgtatctgatctcttcttcgaagatgaaacaggccaagaaaaagcttgctgacacagaacctttcttctatgccatgcaggcagagatcgccagaattttgcggcatgtgccggatatgcacagccagttctttgatggccgtgagagtatcccggctgaggaaagaaagattggctatatcgttgtaactgctgataaaggacttgccggggcatataatcataacgtgatcaaggcaactgaagaactgttaaagaaaccgggaaagcataaattattcgtacttggagaagccggaagacagtactttgccaagagggaaggaattgagatggatactcagttccgttataccgtccagaatccgacattacacagatcgagaatcatttcttcggagatggtagaacagttcagaaatggagatttggacgagatccacatcatatacacacgtatgatcaatgctatgacagcggagactgaggaacagaagctccttcctatgaagaagacgaccttccttccagaagatatgccggctcttgtcggaaccggactgtatcaggaagatatggtattctggccatctacacacagtgtgatggcgaacattgttccgaactacatcaacggtatcgtatatggatgcctggtagaggcctactgcagtgagcataatgccagaatgcaggcaatgcagaatgcaacagacagtgcaacagatatgctgaacgaattaaatattacttacaaccgtgtccgccaggcagacatcacacaggaattgacagagatcatcggcggagccaatgcgcagaaacggaagtaagatacaaagttcgcaaatggcggaactgtatacagaacaaataataaccacgaaataataaaaaagaaagtgggcagcagtaatatgacaaaaggaagaatcgtacaggtcatgggacctgtcgtagacgtagaatttaatagtagagaagaacttccatttatcaaagatgccctggaagtagacaatggcggaaaacgttgcgtcatggaagtagcccagcacgtaggtaacaacatcgcacgttgtatcatgctggcttccagtgaaggtctgcagaagggaatggaagttaccgctaccggagctggtatcaaagtgccggtaggtgagaagactctgggacgtctgttcaatgtacttggagagacgatcgataacggagaaccaattaaagacagcgaagaatgggttatccacagaaaagcaccaagctttgaagaacagagcccggctgtcgaagtattagagacaggaatcaaggtcattgaccttctgacaccttatgcgaaaggtggtaagatcggtctgttcggtggtgccggtgtaggtaagaccgtactgatccaggagctgatccataacatcgcaacagaacatggtggatattccatcttcaccggtgtcggagagcgttcccgtgaaggtaatgacttatggacagagatgagagaatcaggtgtacttgataagacagctttggtattcggacagatgaatgaaccacctggatctcgtatgcgtgtcgctgagacaggacttacaatggcagaatatttccgtgatgtagagcaccagaatgtgcttctcttcatcgataatatcttccgtttcgtacaggctggttcggaagtatccgcacttctcggacgtatgccgtcagccgtaggttatcagccgacactggcaaacgaaatgggtgcccttcaggaacgtatcgcttctacaaagaacggatccgtaacatctgtacaggccgtatacgtaccagccgatgacttgacggacccggctcctgcaacaacattctcacatttggatgcaacaaccgtactttccagaaagatcgttgaacagggtatctacccggctgtagatccactggattcgacatcccgtatcctggagcctgcagttgtaggtgaagaacattaccaggtagcacgtaaggtacaggagatccttcagaaatacaaagaattacaggacatcattgcaatccttggtatggaagaattatccgaggaggataagctgacagtagcccgtgcaagaaagatccagaaattcctgtcacagccattctcagtggctgagacatttaccggtgttcctggaaaatatgttccactgaaagagactgttcgtggattcaaagcgatcattgacggagagatggatgaatatccggaaaatgcattcttcaatgtgggtacgatcgaagacgtgatcgcgaaagcgaaggcagaaggagtggcttagtatgagcacattttcattgaaaattatatccacggataaggtcttctacgatggcaaatgtgaatacctggtgattccgactatagacggggaaaaaggtattctggctcatcatgagaacatggtcattgcagtggagatcggagaactgcgtttccgtaagccggacggtgagtgggtaacagcagttgtatccaaaggatttgcagagatcgtgaataaccgtgcttctgtactggtcaatacggcagagcgtccggaagacatcgatgtgaagcgtgcagaggaagcaaaggaacgagccgaagagcaggttcgtcagaagcagagcattcaagagtattatctgtcacaggcttctatggcccgtgcaatgacaagactgaaagcgtccagaaacagacgcggggatatctgatctgagaaattaataaaagctatgataaaaagagctgtcgttttacgaaatgtattcgtgaaaacgacagctctttttgcggtgatttatcttgtatgccgcctgtagcttgcaggcgtctcttcatatttttcctggaataatttataaaaatatcctttgttatgatatcccacagaatcagcaatttcctcaatactcttatcggttgatacaagcagatgctctgcacgctcgagacggatctgctggagataagtggaataggtaagtccggtcttacgtttgatcaggcggttgaagtaatcttcctgatagtggaattcatttaccagatcctgaatggtgatatctctaaaatgtgcccggatataatctgagatctcttcgaatacgatccagttcatcgtctgcttctgctctttggaaagagaaaaatcatactgcgtacttaagatcctgaatatgcggaataacagaccttttgtgatgtatcgtgatccgctgtccggcgaataagattctttcaaaagcaataaaagactgtcgtccagagcttcacttgctccggctgatggacggaaatgcaggaattgctggacatccttttgctttaataaggcagactgcaggaaagaaagaatcttctgcggggtgctgttctcgttcatgatctccgtaaacatatcattggcgattccaagaaaaagaaccactcccgactggtccgtcagacagtcctgatgcaggcagttcttgtcgatcaggcagagttctcctttttggaatacgacatctttattcagtatccgctgatgaaattccccatctacaacgtaagaaagctccagataatcatgcgtgtgaagctgcgtatattctccatccgaataagaataatggtaacagaaattctccggggagggcatcattgttgcatacagattaccaggagaatcaaagttccagcataacaggaaactgcggtcctgactgagtaacggataagtcttaacttcctggacggacttggaatattccggacagacaagtcttgcgcctaatttatggttttccggaagaagccgggcatcaggtcctgtgatccggcggcaaaaatcggataaattcatacaaatacctccttgacatctagtatgattataccataacagaggtcggaataggtaacaatttttccaaaagtgcagagtttagagattgagaaagtaagtttgtatttttataatagagacataataaagctgtagacgaaacagaaaatttaaatgaaaaggagtaaaaaatatgttaaaaacaaaaaattatcagttttggttctgtacaggatcacaggatctttatggagatgagtgtcttgcacacgtagcagagcattcaaagattatcgtagatgcgttaaataaatcaggaaaccttccatatgaagtcgtatggaaaccaaccatgattacaaatgaagtaatcagaaagacattcaacgaagcgaatacagatgagaactgtgccggtgttatcacatggatgcatacattctctcctgcaaaatcatggatcttaggattacaggagtacagaaaaccattacttcacttacatacacagttcaaccgtgaaattccatatgacactatcgacatggatttcatgaatgagaaccaggcagcacatggtgacagagaatatggacacattttcagccgcttgaatatggagcgtaaagttgttgcaggatattgggaagatgaagacgttcagaaacagatcggatcatggatgcgtacagcagttggtgttgtagaaagcagccacattagagttatgcgtgtagctgacaatatgagaaacgttgctgttacagaaggtgacaaagtagaagctcagattaaattcggatgggaagtagatgcttatcctgtaaatgagatcgttgaagctgtaaatgctgtatctcaggcagatattgatacattagtagaagagtattatgacaaatatgatatccttctggaaggaagagatgagaaagaattccgtgagcatgtagcagtgcaggctggaatcgaacttggatttgaaagatttttggacgagaagaactatcaggcaatcgtaacacacttcggagatcttggtggactgaaacagcttccgggacttgcaatccagagactgatggaaaaaggttatggatttggagcagaaggtgactggaagacagctgctatggtacgtgttatgaagatcatgactcagggaatgaaggatgctaagggaacttcattcatggaagactatacatacaatcttgtaccaggaaaagaaggcgttctggaagctcatatgcttgaggtttgcccgacaatcgcagatggaaagatcagcattaaagagcagccactcagcatgggtgacagagaagatccggcaagacttgtattcacatctaagaccggaccggctgtcgcaacatctctgattgacctcggagacagattccgtctgatcatcaacgatgtagactgcaagaagacagagaaaccaatgccaaaacttcctgtagcaacagcattctggacaccacagccgaacttaaaggttggaacagaagcatggattctggcaggaggagctcatcatacagcattctcttatgacttaacagcagagcagatgggtgactgggcagcaagcatgggaatcgaagccgtatacattgataaggatacaacaatcagacagttcaagaacgaactcctgtggaacagtgttgcattccggaaataattgaaattatcacataagcagtaacatttcattttgcaggggatatcaaatagatatttccctgcaaaaatagtataatgggtagtatataaaaagaaaacttataaaaataatattaggaggaagcgtacaatgagtaacataaaagaaatcattgagagcggaaaagcgtttctgggaatcgaattcggttctacaagaattaaagcggtactgatcgatgaggagcacaatccaattgcatccggaagccacacatgggagaaccgttacgagaacggactgtggacttactctctggatgatatctggacaggtcttcaggacagttaccgtgacatggcagaaaatgtacagaaagagtacggagtaacaattaaaaaactcggagcgatcggattcagtgccatgatgcatggatatatggcatttgacaaagaaggaaagcttcttgcaccattccagacatggagaaacagcaatacaggaaaggcttctgaagtgctggtagatttgttccggtacaacataccactgagatggagtattgcgcatctgtatcagtgtatcctggataaagaagagcatgtaaaagatattgcatttatgacaacgcttgcggggtatatccactggcagatgacaggtgagaaggttcttggtgtaggtgatgcatccggaatgttcccaattgatatgaatacaaaagattacgatgaagagatgatccaaaagttcgataaactcatcgaaggtgagaactatccatggaaagtaaaagagatccttcctaaagttctggtagcaggagacgcagccggtatcctgacagaagaaggagcaaagaaacttgaccctacaggcaatctggaagcaggaattccactttgtcctccggaaggagatgcaggaacaggtatggtagctacaaacagcgtagcacagcgtacaagcaacatttccgcaggtacttcattcttctctatggttgtccttgagaagcctctgaaagatttgcatacagagattgacatggttacaacacctgacggaagtctggttgctatggtgcattccaataacggaaccacagacctgaatgcatgggtaaatctgttcaaagaattcgcagattctatcggagcagacgtggatatgaaccagatgtatggaacactttacaataaagcactggaaggcgatgctgactgcggcggaatcctttcttacggcaactatgcaggagagcctatcacaaatgtagaaaaaggacgtccgatggtagtaagaacaccggagacaaaattcactctggcgaacttcatgaggtctcatctgtacacagcacttggtgttatcaaagtcggaatggacatcttaacaaaagacgaaggtgtagagatcgatactgttctcggtcatggaggactcttcaagacaaaaggtgtcggacagaagattttggctgatgcgatcaacacaccggtcgtagttatggagacagcaggagaaggcggaccatggggaatggctatcctggctgagtacatggtaaaacgtgcagaaggtgagaaactggaagattatctgaagaataaagtattcggaagcaatgccggaagcagaattgatccggatccggaaggcgtagcaggatacgaagcatttatggagacatataagaagggacttgacgtagagcgtagagcttgtgctgatctgtaaaagctgtcatattgtgtaaaagtagaggggacacggtgatgtccccgtatctgttatgatatagaagaggtaaaggagataagaaaaatgctggaagaattgaaaaaagaagtatatgaagcaaacatgcttcttccaaaatatgatctggtaacatttacatggggaaatgtaagcgggattgatcgtgaaaaaggactttttgtcatcaaaccaagcggagttgattatgataaattaacaccggaagacatggttgttgttgatcttcagggaaacaaagtagaaggagacttaaatccatcttctgatacagcgacacacgtagaactgtacaacagattcccgaatattggcggcgttgtgcatacacattctccatgggcaacaagctgggctcaggcaggaagaggaattccttgttatggaactacacatgcagattatctgtacggaacagtaccatgtgtaagaaatcttacaaaagaagaaattgacgaagcttatgagaaaaatacaggtgtcctgatcgcagacagattcgatgaagatgatctggattatgttgcaacacctgcagtactctgcaagaatcacggaccatttacatggggcaaggatgctcacgaagcagttcataacgcagtagtattagaggaagttgccaagatggcagcaagatgcgaaatgatcaacccggacgtaaaacctgcaccacaggaattacaggataagcattacttcagaaaacatggagcaaatgcttattatggacagccagggaaataaatgaattggtgttaaaaaaggattacaagagacactgccagtgatgacagtgtctcttgtagtcttggtattcattcggttttatactgttgtgaacaggtcgacagactgtccggtcataactgccggtgaatctgccaaaaggtagatgattgcttttgcaacatcttttgagcttcccatcgggcagccgtcctgtcctacagagtggttgtagactctctgtcccggtgtgtccacgattccaggagatacggcattgcatttgattccgtattctttggtctggatagcagttgtcttggtcatggttacgataccgccttttgcaacagcgtatgcacccatctgagatgcaatacgacccattcttgaagatacatttacgatatctcctttttcttgttttatcattacaggtacaacatttttagttacaaggaatgggattctcaagtttgttttgatgatctgatcccactgttcttctgaccattcccagatcttaattgcctgatgttcgatatttttgtagatctcttttgggtatccgcctgcattgttaacgagaatatcaattcttccgtatttatcaacaacagttttgaccatgtcggcaacctgttctccgtctgtaaggtctctggaaagtgagattgctgttccgccggcatcttcgatcatttttactgtttcatcaagatcagactgtgttcttgctactgttacgacagtggcactttcagcagcaatagcaagtgctgcgtcacgtccgattccttttcctgatcctgttacgattgcgatttttccttctaatttacccatgacatatatcctccaaaattatatttatacaagccttgctgtttcagcaaagaactgaatgtctgtagcttcgatgtagctgttaccgatttcatgaagtagtatgacgttgagattaccgttcagattcttcttgtctaaggcgatcgcttcggttaatgtcccaagagtgagaccgcattcaaaaggaagtccgtaggtttttaaaacctgctggatacggtctgcagttccttttggtgttaatcctttttcctcggcaatcatggtaatctgatacatgccaatggcaacggcttcgccatgactttcccgctgataatggaaatgttgttcaatggtgtgagccagtgtgtgtccgaaattcagtaacatacgttcacctgtgtcaaactgatcattttctacaaccattcgtttgatatctacacagcgtgtgatgatggcaggcagttcttcttttaaatcttcaaaagaactgtgtgattccaagatagtaaataaatccgcatctttgatgcagccgtatttgataacctctcccataccatcgttgataaatcgttccttcagcgtgttaagtaccagtggatcgatcagcaccagtgaaggctgatagaatgcgccgaccagattcttgccttccggaaggtctactgcgacttttccaccgacagaagaatcaacctgcgccaacagtgaagttgggatctgtaccagtcttacacctcttagataactggaagcggcaaatcctgcaagatcaccgatgacaccgccgccaagagcaatgaccagatcacttctggaaatctttgcttccagcatggctttgtagactgtcggaagtgtctggaaatccttggtggcttctccgtgagggagtaccagatgatggcattcataatctgaatccagtgtacggatcagtgtatctccgtatagaggaaatacattatcgtccgaaatgatcataatgcgtttgccgtgatacatcttacggatatagttccctgcttgggacaatatattattttcaatataaataggataactgtctttttccagattaactgtaagtttcattttaaagctcctgtaaactatgaggctgcatacattagatggattttccgactacatttgcaatctgtgcaacctgtttgagtaattcgtcgtatttattaggttttaatgactgtgctccgtcgcagagtgcagattcgggatcgttgtgtacttctatcatcagtccgtctgctccggcggctatagcagccattgccatggaatctactaaccaccattttccacctgcatgacttgggtcaacgatgattggaagatgtgtcagtttacgaagtacaggtatactctgaagatccagagtatttcttgtatagctttcgaaagtacggattccacgttcgcagaggatgacattttcattaccggatgccatgatgtattctgctgacatgatccattcttcgtaagtagcattcagacccctttttaagaggattggacgatcaagctgccccaattcttttaacaggtcgaagttctgcatattacgtgcaccgatctggataagatctactttttcgttaaatacatcaaggtatttgtcggacatcagttcagttacgatcggaagaccggtctcttctttaactgcggttaagatatcaagaccttcaagcccgagtccctggaatgaataagggcttgttcttggcttgaatgcacctccgcggagtaagttggctccggaagcttttgctgcccgggcaatttcaagaacctgttcgtatgattctacggaacaaggaccggcgatcattgcaagattgtctccgccgacttttacgccggatacattgataatggaatcttccggatggaatgcacggttagctaatttgtacggttcctgtacatgcataactttatcaactgcagaatcaatctcgaataatttggaatcaactttggctgtgtcaccgatacagccgatcactgtcatctccttgccttgtacaatatgtgtgtcaagacctctctttttgaccatgttctcaacacgagaaacatcatcttttgtagtatatggttttaatacgataatcataattaatatcctccaatatgtatgatcattgtgcctgtgtgatattttctttctcgtgtgaatctgttgtggtcgcactgtaaaatattcgcactgcaaaactttaaatacttaaagtataaaactaatgatatattaacgcaatggaatttgattgtcaatacttttattggataaattctttcatttttttaaaagtgtgttagactaaaattgtatagtaaaaagggagtgggaaaatggtaaatgtatgggcagcagatattacaccactattaatagaagaaatatatcgtgcatattataacagggtgccaaagtggagaaaggaaaaagcggataagctgcggaatgtggcagaccgtgcaaggagtgtcggtgcatggatcttatgggagaagatacaagagatgaccggacttcaggaagatgctgtattcaatctgtcgcattcgggaaagtatgtattgtgcgcctgcagtgaccgggaaggcgtgcaggtcggatgtgatgtggagatgacgggagcattaaggatgtcagtagctgaacgctatttctgtccatcagaatgtaagatcatccgtgcaggtgcggatgaaaaagaacaggcagaatggttctaccgtttctgggtattaaaagaaagctttatgaaagccaccaggaggggcatgggactggatatgcggacatatgaatttgcctggaggccggatggcataccatatatgagaaagcagccggatgaatatcccgggatctacctgtgcagggaatatgaattgaagcagggggatgcaagagccgcagtgattacgacagatgatgaaatcggggggagattacaagaagtcagacttgcttaaaaaggggtgtatgaacatgagacagttaaagacgaaatgggcagacaatataaatgaaaagaatgtattaggggaatatccaagaccattgatgcgccggaaaagttatgtgaatctgaacggtgtgtggaaatatgcaataaaagacacaaaaggatttccaaagaaaatgaacggagacatattggtcccgttttcaccggaggcagcactgtcgggagtcggaagacagttaaagccggatgagtttttatggtataaaaggagtcttccggaagagataagaccagaagcaggaagccgctggctgcttcatttcggagctgtggatcagtgtgcagttgtctatgtaaatggaaagaaacaaggaaaacatgtgggcggatatctgccgttttcattcgatgttacggatgcattgcaagaagaaagaaatatactgacaataaaagtaaaagattattccgatacatattattacagcaggggaaaacagaaattagaaaatggcgggatgttctatacggcgcaaagtggaatctggcaaacggtatggatggaaaaggttccggagtatcacatcaaagatctgaagatcacaccgctttatgatcagtcttccgttatgatacagctggaagatgccgccggaagaaaagatatcgactatgatgtgacggtaacggcaagaacgatgtggccgttaaaaactgccggtaggacagggagaccatgtatggtgagaattccgcatatgagaaactggagtccggaggatccgtttttatatgatgtgcatataaagatggggaatgattcggtagagagttattttgccatgcgtaagatagaagtgaagaatgacaaaaacggaatcccgaggatctttttgaacaacaaaccatattttcaaaaaggagttctggatcagggatactggccggacggcttgtatacaccaccgtgtgatgaagcaatgatctatgatatccagaagatgaaggatctggggtttaatatgatccggaagcatatcaagatagaaccgcagagatggtattatcattgtgaccggattggcatgctggtatggcaggatatggtgaatggaggacgtgaatataagagctggtatgttacctggctggcaacagctatggaaggaacacatatccgtgcaaaggatacaaggctgcatctgatgggacgtcaggatccgaccggacagaaacagtttgaaagtgaaatgaaagaaacgatccggcggttatataatcatccgtccgttgtgacatgggtgatatttaatgagggctggggacaattcaagacgaggaagatgacagacattgctctggcagaagatcataccagattgattgattctgcaagcggatggtttgatcagggatgtggggatatcaaaagtattcatgattatttcttcccgttgaatatcacaccggaaaagcgggtgacagcgcttaccgaattcgggggatactcgcttcagattccgaagcacagtatgtatgaaaaagatatttacggatataagatatttaaaagaaaaaaagatctcagcagagcgtatgaaaaattgataaaaaaactcgttatcccgaatatcagcagggggttaagtgcgacggtctatacgcaattatcggatatagaagaagaggtaaatggaattctttcttatgacagaaaaatagtaaaaatcgatgaaaatgtggtgagggaatggaacgaaaaacttcatttttaaccggaaattcagggaaaattgatgagttgcgtagttgacgtgatttcggtgatttgttagaatataaaagggaaaaataaagatttatcaagatagaaaattgtttacaaaaccataaaaaaacacatgaggagagtatgggagcgtaagaataattaaggaggaagacgatgttggaattaacatttggagaacaggtcaagatcattctgagccgtaaaggaatgaccatcaaagaacttgcagaaaagatagaaaaacagacaggaaaaaagatgtcgcgccagaacctgacacaacgtctcggaagagataatttccaggagcaggatatgcgtatgatcgcaaagattctggaatgcccgttctatttagatatattagaagaacatgaagaccgcacagagaaaccggtgaaagaacagaaagctgcagaaccggaacagaaagaggcacctacaagagcggaagaaagggatattacgattggagaactggtcgatattcataaagaattagatgcgattgagaagaagaaaagcaagaaaaaagcaaagaaagttgtagaagagaatccggaatatgtccaggagacgatttttgacttctttgtgaatgagaaagcagcagagccggaagtagaagcagaggcggaagtggaagcagagccggaagtagaagcagagccggaagtagaagcagaggcggaagtagaagcagagccggaagtagaagcagaggcggaagtagaagcagaggcggaagtagaagcagagccggaagtggaagcagagccggaagtggaagcagagccagtatatgaagaagcagagccggagtatgcagaagagtcggtatatgaagaagcagagccggagtatgcagaagagccggcatatgaagaagcagaaccggagtatgaggaagagccggaagtagaagaaccggaaccaaagaagactgagacagagaagaaggcacatggctggagagcatttttcggaatccataaaaagcatgaagaaccggtgaaagaagaaaaagaggaagaaaaaccggaaatccaatatcatgaatttgattattcagaagatggagaatcaggcgaacttgcagaagagtttcttccagatgaacctgaggaagcagagacatatgccgcagagacagaaacggctgcttatgaaaatgcagaacagttaaatacgaactatgatgcaggacatcagaacaggtatgcacaggagaatgaagaggatttatttacatcaacggaagaggatcttgagaaaggggaacttaacccttacaccggacatgaatatgaatcgaacagtgtaagaatgcatccgaaccggatcggctatgtgcaggtatatgaccgtggaagtcatcagtggacagatatgacggagtgggcgtttctcggatatcaggagcgtaagaaagcgttacttggcaaagattatgagccgccgatctatctggattaatggaaaatgaacttaagaaagtaatgctgtaaataaggtgttcagccggagatccggctggacactttttgacaaaaaggaggatgtaaaatggagtggacaagacttttatcgacaaagagacaaaggccgggcagacatcaggatgtacgttccgccgataccgatctgagaagcgaatttgaaaaggattaccacaggatcatcggaagtgcatcatttcggagacttcaggacaagacacaggtatttccattagataaaagtgattttattcggaccaggctgacccattctatggaggtatcatcgctggcaaaatcgctgggacagaatatcggcgaaagcatactggcacataagaaagatacaagtttcactccggggatgaaagaagatatttgcaatattcttcagtgtgcaggactgattcatgacattggaaatcctccattcggacattatggggagtttgcgatcagagagtggtttgaacggaatcttccggtgttaaaatatcacggaacaccgatagaagaattgctggaagaacagatgagggaagatttttatcattttgaaggaaatgcacaggcgctcaggctggtgagtaagcttcatttcctggtagatgaaaatggaatgaatcttacctatgcgcttttaaacacaattataaaatatccggtggcatctacacagatccggccaaagtccggggatatccgtgaaaaaaagatgggatattattatgcggaccgggagttattcgaagatatcgtgatggagacaggggcgggaaattgcagacatcctctgacatttattctggaggcagcagatgatattgcatataaaacggcagatatcgaagatgcatttgtgaaagggttcattacttatcacagtctgcgggatgaattgcggaagcttcaaaacagggaaaagaagctggcagttccggaacaggcggaatggaataggttccggccggcagataaactggtggaattatatgaacgtgcaaagaaaaacggagtagataaccccggagattatgcagtgaaaaactggatcgtaaaggcacagggagttctgatcggatatgcaacatctggatttacttctcattacgatgagattatgaatggagtatataaaacagatttattcgcagatacaccggcggaagaacttgtaaaattacttggagagattgcatgcaaatgtgtgtttaagtcagaaacaatctaccggatggaagtgaaggaagcagtgatgcttgacaatctgatggaccgcttcatgggtgcgataattaaatatgatgatccggcacagaaactgaattctatagaagaacggctggtttcgtttatttccaataattacaaaaaagcataccgctatcatgcggagggacagccagacatttaccggttgtatctgagattattactggttacggactatatctgcggaatgaccgacagctatgcgaagaggttgtatcaggaattgaatgcgattatggcataaaagagaatatttcagaatagattgtgataaatagccgtaaacaggagtgggtattttgagacggtttattcgatatctgtatgaatacgaacaagagaagaagatgcggaatgtaggcttcgtaaaaatagaacaggatatggaacagtgtgtgatccatgtacacggaaaaggattccggatggaagaagacgcaaagggactggaagtatatttgttctggaatcaggatgaaaaatgtaccggaatcaatatgggagtgacagagccgccgtctcccggactgaattatcaattgtgttatacaccggaagatatgggggagaaagaaaattatgatctggtcaacggaattattttgaaagacataagcgggcactgttatgctgcagtgtggaatgacgatgcggtaaatatctgtcagatggaaaagtgggaggtggcgaaggaagagacgcatgaaaaagaaaagagtaatgcagaggcttcagaggaacaggaagtaaaggaatgtgggaaaagatacaaagtcagaaaaattcaacggaaagatatggtatgtcttccgagatgtgaatggaagcatgcgaacaatagttttctggttcatggatattataattatcatcacctgatattgacagtctgtgatggtcagttaaaattaggagtacctggagtatatcatccacaggaagcaaaagcagcagaaagttttgggtttccggaatttctgccggttgaggagaccggacttgcgcttacggaagaagaaacgaatgacagagagacattcggatactggtgcagagatgtccgcgggtcggaagactgcgcagatatacaaagaaaaatataatcagatggagtgtggaaatgcaaagtacagatgaaaaatatatgaaagaagcaatcaaacaggcgaaaaaagcttatgcgatcggagaagtaccgatcgggtgtgtgattgtgtatcaggataagatcataggaagagggtacaaccggagaacgattgataacaataccctggcacatgcggaactggttgcgatcagaaaagcaagcaggaaaatgaatgactggagactggaagattgtacgatgtatgtaacactggagccttgccagatgtgttccggtgcaatcgtacagtcccggatgacaagggtggtagtcggttgtatgaatccaaaagccggttgtgcgggatctatcttaaatcttctggatatgccggaatttaaccatcaggtggaattgacgacaggagtcatggaagaagaatgcagccagatgatgaaatcattttttaaagaattaagagaggcaaggaagaagaaaaagcagctggaaaaagagcagacagaggaaatataagagacaggtgaccagatgaatgaaaagacggtaggaatgctgatcggtaagaagaatgtatatgaatatccggaactttccaatgcagttacctgtatgaattatgtaaacaaagagaccgagataccgccggtactgatgatgcacggacttgcagatgacaaagcatggagatccggcattctggacagagaagaataatttggtataatataaaaaaatatccacatgcgggaaactgcagtggatatttttaatatctgtttattttattatgtgcattgcgcttcgaacgagccttcacagacgttaccttagtagttaactcagcccaggcacccttacggcacccggaagattccacttaatgctgcttcattcctgacctgacatggttcatggagttccgtcgcgtaagacccaaacatcaacgccactttccaagggcagctctgcaaaaacaagccctctgcgcaatatcacccctgctatagcggattgcaggtgcaaggtaccgctaacaccccggctgcacagctcaatattttaacgtgttccggacaaaaagtcaatggaaatgttgtaaaaaaggcgataccaatttataatacctagatatatgaggatttatcttatccggtatatgaccggaggagagattctgatctggaggaaagcataatgaagatattactggcagcagtcaatgcaaaatatatacattccaatctagcggtctacagtctgaaagcctatgccgaagatccggcggtggagatcggggagtacacgatcaatcagcagaaggatgatatcctgatggatatctataagagaaaaccggacatcctctgcctttcctgctatatctggaacctggattatatagaggagattgtgttggaaatcggaaaattacgcccggatatgccaatctggcttggtggtccggaagtttcctatgatgcgcaggatgtgttaagacgtctaccgtgtgtcaaaggtgtaatgaaaggggaaggagagaagacatttaaagaaatttgccggatataccgaaatgaattcgaaaaaaagaaagagaatgtggataactcctggaaaaaatcagagagtgtggataaccagttaaaaaatgttataggcattactttccggacagaagaaaatgaaatcatcgataaaccatggcggccgatcatggatttaagtgaggttccgtttgcctacgaccacatagaagattttgaacacaaaattatctattatgagacaagcagaggctgtccattttcctgcagctactgtctgtcttcggtagacaagcgcctgcggttcagagatatagaactggtaaagaaggaactgcagtttttcctggaccataatgttccgcaggtgaaattcgtcgatcgtacatttaactgtaagcacgatcacagtattgcaatctggaaatatatcatggagcatgataatggaatcacgaatttccattttgagattgcggcagatattctgaatgaggaagaactggaattgttagaacagatgcgccccggactggtacagcttgaaataggtgtgcagtcaacaaatccgaagacgattaaagagatccacagagttatggattttgaaaaagtatccagaatcgtgaggagaatccaggagagaggaaatgtacacgaacatctggatctgattgcgggacttccatacgaagatgtggaaagcttcgcacattcttttgatgatgtctatgcattaaaaccagaacaactccagttaggattcctgaaagtgctgaaaggatcatttatgcaggaacatcagaaggaatatggaattgtgcacaaagcgcatccaccgtatgaagtactttatacaaaatggatttcttatgaagatgtattgaggctgaaaggcgtggaagagatggtagaagtgtattataacagccgtcaattcacgaacacgatggaagaactggaaaaagaatatgattctgcatttgatatgtatgaccggcttgccgcttattatgaagaaaatgattataattcagttcagcacaagcggagtgcaagatatgagatcctgttaaattatgtgagaaaatatcacaaagaaaaagaagatttattccgggaagtgctcacttatgattattatctgcgtgaaaatgcaaagagccgtccaggatttgccggagaatatccggtaacgaaagatgctgcaagagcattttatgagacagaagaggagacgcatgagtaccttccagattatggaaaatacgacagaaatcagatgcgtaaaatgacgcatctggaatatttcaaactgacagatacatatattttatttgactatcagaacagaaatccgctgaatcaggaggcaagagtctgtaagatagagaaaattaaattatgaaaagggcgtacgatctgcagtgtaagaagtccgaaatgtgaggattgtttcttgcaaaaatattgtaaagagtataaaatgtagagaaatacgttactgtttacgtaaaaattgataagaatgagaagaagcagtaacgaaaatataatcaaagaaggtagaagaatgaatttcaacaataaaagaacaagaagaattgtatcaattgttgtgcttatcgtcatcattgccatggtagcaacgatgattattccgtatcttgtataaatataaaaggggaacataataaacatgaagttagagacacagacagaacagcttataagcgaaacagttaccgtctacggtttatctccgcagatcggtgtccatgcacttgcacagactgtgaacgcactggcggcacagggtgcagtgttctctgtctgccctgatataacagaggatgaggagcaggaagcggatatccggagtgaggatatgcaggatacgcatgaaccatctgcaggcattagtgtacagatcgcctatccggaatacgtgttcaaatccagaatccacaagattgaaaagcttctcaaaaaagcatgcaaaaagtataatatcatgcttgcaggagtacaggcatctgtcaatccggcggttcgggcgatcgcagtgacggttacaggaatcgcaaaggctccaaaggaagaagcatggaaccgggaaaccgcacgagcctgtaaggatattgtgttcgcagggcatgcaggaatggatggtatgctccggatcacggaagaaaaagaacaggaacttaagactcgttttgcgccggttttcatgaagcagataaagtcatacggacagcagatatttgctccaaaagaaatcgaagccgcaaaagccgggggcgcatttgtcgtacgtcaggtcgcagatggcgggatcttggcagcactgtggaatctggcactggaattagagcagggactggatcttgatatgaagaaaatcagtattttacaggaaacgatcgaggtatgtgaacatttccggctgaatccatatcagatgatatctacaggaagttttctggctgtgactgacaatggggaagtactggcagatgcgctgaacaatcaggggattacagcagcagtaatcggacatacaacagacaacaacgataagatcttaagaaatggagaagagatgcgttatatcgaccgtccggctccggatgagatcttgaagctatatagcggaggtatgaatgatggaagaattaagaaagcagatactcctgtatctggagaagcatagcagggtggacctcggagaactggcagttcttcttggaaccgacgaagtaaccgtagcaaatgagatttctgccatggaaagagcaaagatcatctgtggctatcatacactgatcgactgggataagacaggaacagagtatgtgaatgccctgatcgaagtaaaagtaacaccacagcgtgacacgggatttgataagacagcagaacggatctgtaattatccggaagtatcagccgtatatctgatctccggtgattttgatatgatggttctgatcgaaggcaagactttgcaggaagtgtcaaggtttgtatcaagtaaattatcaccgatcgaagatgtcacaggaaccagcacacagttcgtactgaagaaatataaggatcacggaacaatcatgttcggacagaaaaaaacagaaaggatgcttgtaacaccatgatgagaaatccattatctaagaaaatcacaggcatcgaaccatctggaatccgtaaattctttgatctggtaagtgagatgcctgacgcaatatcccttggtgtaggagaacctgattttgacacaccatggagaatcagagaggaaggtatctacaccctggaacagggcaagactttctatacatcgaatgcaggtcttaaagatctgaagatcgagatcagcaaatatctggaacgtaagatacatgtagaatatgacccggatcatgagatcatggtgacggtcggaggaagtgaaggaatcgatgtggcactgcgcgcaatgctggatttgggagatgaagtcctgattccgcagccgagctatgtatcgtatgtaccgtgtaccattctggcagacggtaatccggttgttattccgcttcaggaaaagaacgaattcaaactgacggcagaagaactggaggcagcaatcacgccaaagacaaaaatgttagtcatgccattcccgaacaacccgacaggatcgatcatgacaaaagaagatctggagccaattgcggaagttgtgaaaagacatgacctgtatgtgctttcggatgagatttactccgaacttacatacaagacagagcatgtgtctattgcatctcttccgggaatgcaggaaagaacactggtaatcaacggattttccaaaggatttgccatgacgggatggagacttggttatatctgcggaccgtctgtgatcatagaacagatgttgaagatccatcagtttgcgatcatgtgtgcgccgaccaacagccagtacgcagccatcgaaggcttgcgtcactgcgaagatgaagtgcagcagatgagaaatgcatacaaccagagaagaagatatctggtaaatgaatttgcgaagatgaagctggaatgcttcgagccattcggtgcattctatatcttcccaagtatcaaagaattcggtatgacttccgaagaatttgcaatgcgtttcctggaagaggagaaggttgcggtcgtaccgggaagtgcgtttggtgagagtggggaaggattcctgcgtgtatcgtatgcatactcactggaggatctgaaagaggcgattggaagactcggccggtttgttgagagactgagaagccagaagtaaggttgacggaagctgatttgaagagaatttaaaagaaataatagaaatagaaaagtcgtcagggaatgttaatgtatgaattagaattatattcctgacggcttttgttattgctatgcagcttctgcagatatcagaaaatacaggatgaattgtataatccggaatttactcttacatttttggaaaaaatcttgacttggagcgaactctaagtgctatagtaatgaacggaaaggtggtgtctggattgacgataaaagaagtaagtgaaacatatgacatttccgctgataccctgcgttattatgaacgcatcggcatgataccggaagtaacacgtacggcaggcggaatcagagactatcaggaatcagaccttggatgggtggagcttgtgatctgtatgagaaaagcaggacttcccgtggaggcactgatcgagtatgtaaaattatatcaggaaggcgacgagacatttgaagcaagacttcagcttctttcggaagaaagagagaagttagaagagcagaaagcgcagatagagtcagcgatcaaccggctgaattacaaaatttccaaatacgaagaagcagtaaagacaggagtattaaactgggaggagaatagttcatgtatatagaaaagattaacggaccagaagacgtaaagaaattaaccgtagacgagatgaccgcaatggcaggtgagatgagagaagcactgttaaagagagccagtatccacggcggacacttcggaccaaacttcggtatggtagaggcaacgatcgcactgcattatgtattcgagtcaccaaaagacaagatcgtatatgatgtgtcacatcagacttacccacacaagatgctgacaggaagaaaggatgcatatctctatgaagagcattacgatgatgtgtccggctacagcaatccaaatgaaagtgtacacgatcatttcactgtaggtcatacatctacatctgtcagcctcgcgtgtggacttgcaaaagcaagagacctgaaaggggaagaaggaaatgtgattgcagtgatcggtgacggttccttaagcggcggtgaagcactggaaggactggactatgcagtagaattagacggaaatctgatcatcattgtaaatgacaatgatatgtccatcgcagaaaaccacggcggattatatggcaacttaaaattactccgtgagacaaacggacaggcagaatgcaacctgttcaaagctacgggattagattacatttacgtggatcacggaaatgctgtcggagacctgatcgaagcattccagagtgtcaaagacagcaggaaaccagttgttgtccatatcaataccctaaaaggaaaaggatatgcaccggcagagcagaacaaagaagtatggcattataatggaccatttcatatcgagacaggtgagccgttatacgagatgacagaagaagactattcggatatttccatgaattatcttttggataagatgaaaaaagatccggcagtggtagcgatcacatccggaacaccgactgttatgggattcacagaagataagagaaaagaagcaggaaaacagttcgtagatgtcggtatcgcagaagagacagccgtagcactggcttccggaattgccgcaaatggcggaaaaccggtttatggagtatacagtacatttgtacagagaacttatgaccagatcgcacaggatctctgcattaataacagcccggcaactattgtaacattctgtggttcggtatacggaatgaatgatgtgacacaccttggactatatgacatcccgatgatggccaatattccgaatctggtataccttgctccgacaaccaaggaagagtacctggcaatgcttgactggagtatcgagcagaatgagtatccggtaggaatcagacttccgggcggcagtgtgatctcagacggaaaagagattacaaaagacttcggtgatctgaacaaatacgaagtaactcagaaaggttctaaggttgcattgatcggacttggaacattctacggacttggtaaagaagttgccgaagagcttaagaaagtaaccggaacagatgcaactgtgatcaatccatattatattacaggtattgatgcagaacttctggaagagcttaagaaagaccacgatgttgtgatcactctggaagatggtattctggatggcggattcggcgagaagatcgcaagattctacggagattcggacatgaaggttctgaacttcggactgaagaaagagttcctcgaccgttatgatgtagcagaagttctgaaagagaatcatctgacaaaagagcagatcgtggaagatataatgaagtttatttaataattgaataaataaataaaacgtatgtgatatactactataaacaaccgcaatatgggtggatttctattactcaatatggccaaccactttgagcggttgttttttgtataattataatatcaaagaaatatatctttagcaagtaatataaaaacaaaaaggaaatttttaattgtaatttgttggtatgccaacagctaaaatcatgtaaaataagatagaatcatacgatcaataattttaaaaatacatacgaaaagaaagagaggacacacacatggatcacatatatgacgtaatcatccttggcgccggtccggcgggattaagcgcaggcttatatgcaggcagaagcagactggacaccctgatcatcgaaaaaggacaggccggcggccagattatcaacacagacgaaatagaaaactatccgggacagatcgtagaaggagagacgggagtttctcttgtacgcagaatgtatgaacagacagaacagttcggcgcagaacatgtccgtgatacgatcacaaatgcagaactgagcggagacatcaaagtcctgacaggcgaaaaagatacctatcaggcgaaaaatatcatcattgcaaccggtgcatatgcaagaccgatcggatgcaaaggcgagcaggagtacaagggacgcggaatctcttactgtgcaacctgtgatgcgaacttctttactgacctggaagtctatgtagcgggcggcggggatgcagcggtggaagaagcgctgtatcttacaaaatttgccagaaaagttacgattattcacagaagagacgagctgcgtgcagcaaagtctattcaggagaaagcatttgtcaatccgaagatcacatttctgtgggattcggtagtcgaagaagtgggcggcgacggactgctccagacgatgactgtgaagaatgtgaagacgggagaacttacaaagatagaagccgatccgaaagacggactgttcggactgtttggattcatcggtatgatcccgaataccggcgtgtttgcagataaagtagagacggatgacaagggatacattaagacggatgaggacatgcataccaatgtatcgggtgtgtatgcagcaggagatgtaagagccaagagcctgcgacaggtagtgactgcggtggcagatggtgcgatcgcagcagtgcaggtggagagaagtatgtcggagtattaggaacatccggtagaaatgatgatattttctgccggatattttttatgaatttgtctttggagtaatctcccggctccgatatttcgccggagtaatatgcagctctttcttgaacgcccggataaatgtttctggattctcatatccaagaatctcactgatatccgcaacggacttctgcgtattcaccagaagccgttctgctttctgtatccggagaagccgcttccagtcattaaaagactgtccagtcgtggacttgatcagtctggaacaatacgatagtgagaagccgaaatgatccgcgatgtcctgcagagtgacatcttccagatgactctgcatatagtgcataactttaaaattttccggttggtgttcattcttgtcacggtaagaagattctaccgtattccggtaatggcgcatcatctttgcgctgagctgagtaagcatgccgaccagaacctgatcggaaaatgcatcgtgaaagaggtgctcatggtatacatttagcatctctttctgcgaatcgatcagatgctcaccgccggagtggaagataacgtagtcgatctgctgggaatgatacaatccttcagagaagaattcatttaacagattgttccccttcatcagcggaataaacatctgtgaaaatgtggattttcgcagaaggatgttgaatacgatggaattatcgtcaaagacttccatcgtatgatacacacccggggcaataaaaatcagatccccttcggtaaaatcttttctggtcgtggagatagtctgtgagcaatgtccggtaaatacaaagataatctcaaaaaagtcgtgcttgtgtaaaaacggaggcgtgtaccggttatgtttgctgatgaatacattccggtcattgtctttaaagtattcatcatcattcatttcataagaaatgatatccggcagcagttccgggataatcagatggcggcggatggcatcatccagatctaccttatccagaaatttcttcaactgaccggaagaagcagaaacttcaaaataatctttataaaatttctcatcttcattcagctcaaataattcatttaatgttttccctaaatcagccataatatagtacctcagcatattatgatgtaaatgttaaaaagtatttgtaagaagttgttaattcagtatgttgtaaaaaatagtcaatatctactcatttttaacattataatcacatatatgtcaaaaaaagtcaattaacgtgtcaaaatatccaatattcataaaggtatttctgcgttataatcctcttgaagttaagaaagcgcgcgataaatcataagaaagggataagagatgggtaatacaaagtcatttttgtacagacagagatttggctatggacttggagattttgcttgtaacttaatatggcagatgatttctctgtacttactgtatttttacacagacattatgaaactcaatgcagcatcgatcgctgttatgtttattgtctgcaggattattgatgctgttactgatgtactggttggattcgcaatcgataagaccagaacccgctggggaaagagcagaccatggttcctctttggagctgtgccgtttgcagtggcagcattactggcattcagtgtgccggacatttcaccggatgggaaactggtgtatgcatatgttacatacatcttcctgtcattcatgtatacagtggtaaatattccgctggcgtccatattgccaactttgacggatgatatgaatgagagaaccgtacttgcgacatggagaaaattcttcgcattcatgggttccacgattgtatctgcaaccgcattgtatctggtgaaaatggtcggaaacgggaacgaagcagtcggattccggggggttatgggaatctttggagttgcgggatgtgtatgtttcttgcttacattcgcactggttcgtgagaataacttaagtcagacggaaaagtcagcgaccttaaaagagacgattcagtctgcggcacataatacaccgtggaagttattcgcacttaacattctgttcatgtggacaggttatttcatccagtcgtctgcacttgtttattactataaatattacgtgggaagtgcaaaaatggcaacgatggtagctacggttatgacaatggtaccgatggtggcaaatttaaccgttccatttctggcaaaacgtctcggaaaacgtaacctttacagcgtatccgcaggattacagcttgcaggtctggccgtgatctttatcggaaatgtgaatacatcggtcatcctggccggggcagtgatatctgcagcgggatacggatgtaaggagagtatctacttctccatgcaggcagatccggtggattacggagagtggaagactggtattcagacaaccggaacgttgtcggcaatcaacggtttccttggaaaagtagcacaggcagcagccggaggaatctcgggtctgttactgagctggggagcttatgacgcagatgccgttcatcagacagcaaatgcactgacggcgatcaagatgatgtatatctacatcccggcgctcctgatcatttgctcgatcatcacgatgtcgttttaccatctggataaggaatttccacagattcagaaagaactgggagaacgcaggaaagttcagaataaataatagaaccagaacatatgaaacaagaatgagtgaaaggaattaattatgagtaaatcagcagaaacgaagaaatatatgccgctggttggcgcggcaggaatcggatctatgctcggatccggtatcatcatcggactgtccgctacaattacagtatggcagtcaggacttggacttaccgatggacaggtcggaatcctctcaggagcacttacatttgcaatcgcagcaggatcactgcttgcaggaaatattacaaagttattcggactgatctgttcatttaacctgatgaacctgatgtatctgatcggtgcggcaatctgcgtactgtcaggcaacttcccggtattacttgcaggtctgatcatcacaggatttgcttctggagcagatcttccgatcagccttactgtaatctcacatgatgcaccgaatgaaaaagtatctgcaagtctgatcgcatcgacacaggtattctggcagattggtgtacttggatcttacgcaatggcatttatcgtatctcacgtagaaggcgcagcaggagcaagaatggtattcgcattactggccgtacttgcaggaatcgcattcgtatggagaacattttctaagaaattcaaagagtttcatgcggcaggagatgaataccgcgctgcagaaggtacaaagacttctacagaagtatcatttgcatctctttttaaaggaacagacggaaagaaatatgtatcatttttctcatgcatcattatcttctatgtatgttggaacctgttagctaatacattcggacagttccagacttatatcctggttaaggcaaatgcatcacagtcacttgcaacgggatgtggaatcgtattgaatattgtaggcctgatctgcggaatcttatttgcatctgcagcaggaagtaaacacagaaacaaattcttctatgtaggtatcgtgattcaggcaggtgccatgatcggtatcgcacttggcggtggaacgatcgctatgatcgtaggtatgatcgcatgctacaacatcggtaaccagtttgccggagagtctatttacaaagtatggacacaggagtccttcccggttgaggcaagagcttctatgcagggattcatcaatggattctcaagattctgctgtggattattcgcactggtaacgccttatctggtagcaggtgacagaatccacacaactatgtatggatttgcaggaatcgtcctgatcagtgcaattgccggaacaagaatgattatgttacagaaaaaacacggcgttggacagatgtaagcaggaggagagaacatggcatttacatttcaaatcaataatgatgtaaaattcaaacatgatgaaaaactgttggcaaaagcagaaggcttccgcccggagatcaaaaaagaaagaatccacccggcacggatcgttgaagtgatcgaagatccattgaaattaaatggtgtcggcgtaacagaaagtgataagagcatcgataagattgaggaatacggactgaaaagaaatgataaaatgattcttgactttggagatcacagagtcggaacatttaagattcatatcgatcagactggatccccgatggatgcaccgctgtatatgcgtatcaaatttgccgaacttccggcagagcttgcagcggaatccaaagactatgaaggatggctcagccgttcgtggatacaggaagagttcattcatatcgatgagcttccggcaacactggaacttccgagaagatacagcttccgttatgtggaattgaaggttctggatacatctccgaagtggcaggcagtattctcggatccgacggttgtgacagagacatctgcagattacagtggcttcgaaccgatgcgattcgaagatccggaactgcagaagatttatgatatcggtgtgaagacgctggcggactgtacacaggacgtgttcgaggacggaccaaagcgtgacagaagattatggcttggagatctcagactgcaggcgcttgcaaactacgcaacatttgatcagacggatctggtaaagagatgcctgtatctgttcgcagctatgacgacagaagaaggtaagatctctgcaaatgtattcgtaaagccggagaatgtaccggatgatacattcctgttcgaatacagcctgttcttcatctcgaccttatatgatcttcatcaggcacacccggatgaggagctgataagagaactgtatccgattgccaagaagcagatgaacattacattaaagatgttcgatgagaatggcaaactgaatccggacgagaactatccggtattcgtagactggtccaataactttaacaaagacacagcgggacaggcagagatgatctatgtcatgaagcagttcatcgagcttgccaaagtcgtaagagactctgagattagtatgtatgaaaagaaactggaactgatcacagactatgccaagaacgtgctcttccacccggaaaagaacctttttgcaacagcctgggatgaatacaacattgcaagtcaggtgtggatggtactggcacatgtaatgtctgacgaagagaacaaatccatcatgcagaccacgatccaggagttattcccggtgaagaatattgcaacaccatatatgtatcatcatatcgtggaagcgttattcgaggcgggactggatgaagaagccgttcatctgatgaagagctactggggtaagatgatctcgctcggtgctgatacctactgggaagcatttgatccagatcagccggagtattccccgtatggttcaccaatcgtgaacagctactgccatgcatggagttgtacgccggtgtatctgcttaagaagtatgtgaagaataagtaggcagatgtgctgactgtaaaagggacggaataaaatattacatagtgtgcaggaatccgccggacgggaacatgtccggcggattttgcgtataaaaatatattcaaaaagccgccagtggcaaatgttttattctgatttggataagatgaaatgaaatggaataatatataatgaaatatggaaaatatacttgataaatggaatgatatataataaaatatggaaaacaacactagaaatatagattaccacatgttcggaagaatccatcgatggagagtcctgtagaaggaaggagatgatcctatgactgtagaagagatgaaaaagaagaaaacagaattaggtttcagttgcgagcagatatcagatcgttccggtgtaccattgggaacggtacaaaagatattcagcggaataaccaaaagaccaagatatgacacaatttgtcagttggaaaaagcatttccgatggaacatattatatttacagataatcttggacgagactgcaaagcatctggaaacatgatatcaccagaatatatgaaggaacctgattctaatccatatcctggtatgatggaagaaagcgtatcggcttatcgcatctatggagatggcacagatcatgaaggtgatatctggaaaagttttcgtggaaaaaagcaaggcgaatacacactaaaggattatgaagcaattccggacgaatatagagtagaattgattgacggagtcatctacgacctgaatacgccaaccacgattcatcagcagcttgcatttgaaatcagtatcagattaagagagtacattaggcagaacaaaggattatgtatggtactgccgtcaccggtcagcgtacaactagatgaagatgaccggacgatgctgcagccggacgtcgttgtatgctgtgacagagataaaatccttcgaagtcatgtctatggagctccggatatggtaatcgagatattatcaccatctacaagaaaaaaagatatgggattaaaactgaaaaaatatatcactgcaagagtcagagaatactggatggttgacccggataagaaaaaagttgtagtatatgacttggaacataatgagttaccggccatctatggctttgaagaccaggtaccggtgaatatatttgctggaaaatgtcagattgatttttcggaaatatacagctatatagaatttttatttgaaaaagaatagaaaaaacggaggaacacaacatgttaaacatcgtactacacgaaccagagatcccggcaaacacaggcaacatcggaagaacctgcgtagccaccaacaccagattacatttgatcgagccgctcggcttccgcttaaatgagaagaacttaaagcgtgccggcatggactactgggagcatctggatgtcagaacctatattgattacaatgatttcctggaaaagaacccgggagccaagatctacatggcaacgacaaaagcaccaaaggtatatacagaagtgaactatgaaccggactgctacatcatgttcggaaaagaaagtgccggaatcccggaagagattctggtagatcataaagaagactgcgtgcgtatcccgatggtaggcgacatccgttcgttgaacctcggcaactcggttgcgattgtgctttacgaagcactcagacagaacggatttgcaggtatgaatctggaggggcatcttcacgaattacactggtaagaaaaggaatccaatctgtataaattccatattatttagacaaaataaggatattgtccgttttcgttgagaaaatgagataatatccttattttcgtaccaggtatatgaaaaaatacaggaggcgctggcaggcgtttctacttattaataagtgcacaaatataaaacgacaaaatgataaaaatgtatcaaagtgacatacaatttacaacaaatgtaataaatgtatggtaaaattgcggaaataagattataatttaaactagattttgtattttttgaaggagaggtggtagatgaatggtagaagaaaccattaagaccatcaaggaaacggagaatgaagcggatgagatcataagaaaagcagatgcaacgtgtaccgagatccttgaaaaagctgtcagagaggcaaaagagataaaagagcaggctgtagcaaatgcaaagaaacaggcagaagcagatcttttgcaggcgaaagaagaaggagaagtcttaaagaaacaggcttccgagaagacggaacaggagacagaagcattaaaagcactggctcagggaaaagaagaggaggcggtatccgcagtcatcaaagcattgctctgatgatatgggaagagtaagaacgtgaaaaaataaaaaaggagggatgcagttatggcagtattgcagatgcagcgaatcagtatctgcgcattgaaacatgaccggaaagcgattctggaaaaactgcagtccatgggcatgatagagatgcatcaggtcgcgcaggacgaagccggattcgagaagatggatacgcagagtgcgaaatcaagcttcgagaaacgggtgcagatcacggaaaacgcactggatgtattgaatcagtatacaccggagaaaaaatccatgttcgccagtctggaaggaaatgagctgatcgataaaaagacgatggaagctgccgcagcgaagcaggaagcagtcatggaagtggcgggacttctgatcgctgatcataagaaaattgcggaagcacaggctgagatcgtgaagcggaatacccagatagaagcacttacaccatggatgagtctggaagttgcgatgaattatccgggcacgaaaaagacggtaatgcttcttggaaccatggcggcggagacgacactggaaatgatctacggaaagcttgctgaagatcatccggagatcgaagccgtagatatatcggttataagtcaggataaagatgccgtgtacttaagcgtgttctgtatgaaggaccaggcagcagatgtggagaatacactccgcactgcaggattctcaagaccggttgtatcgacagagcagattccggcaaagcagaaagaagaactggaagaacagatcagacagatcgaacagacaattgcagatatccggggagagatcatatcttacgcagaagaccgggaggaactgaagatcatcggtgactattaccggatgcgtgcagaaaagtacgaagtactgggaacacttcctcagtccagacgtacatttattatcagtggttacgcagcaaaagaagcgataccggcaatccagaaaggaatcggggatgcgtatgactgtgtgatcgatgtagaagagttaaaagaagatgaagaaccaccggtgatccttaaaaataacggattttcggaaagcgtggaaggagtcctggagtcttacggacttccgcataaaggggaaatcgatccgaccgcaattatgtcatttttctatgtatttttctttggaatgatgttatcagatgcagcatatggtgcgatcatcgcaatcgtgtgtctgatcgtccttaagaaattcccgcgcatgagtgccggtatgagaaaatccatgaaaatgttcatgtattgtggaatttctactatggtatggggaattttgttcggtggatattttggagatgtcgtagatgttgtatcgagcacattctttggaaaagagctgacaatcaaaccgctctggtttgcaccgttaaatgatccgatgagacttctgatctattcaatggcattcggactggttcatctgttcgtgggtcttggaatcaaaggatatatgttgttaaaagacggaaaggtactggatttcttctgtgatatcgtactgtggtacattttcctgatcggactgatcctgatgctgcttccgtcagagatatttgcttcgatcgcacagacgaagatcgtgttccctgcagcactgattacattgtcgaaagcaatggcgatcatcggagcactcggactgttactgatgtccggaagatcaagcaagaatccggcactcagacttgcacttggagcatatgatatctacaacatcaccggatggttaagtgatgtattatcatactccagacttctggcactgggacttgcgacaggcgttatcgcatccgttgtcaaccagatgggaagtatgcttggtaagagtgtatttggagttatcttatttatcgtagtatttatcgtcggacatgcaatgaacctggcaatcaacctgcttggtgcatatgtccacaccaaccgacttcaatttgtggaattttttggaaaattctacgaaggcggtggaaaacctttcgaaccgtttcatgcggagacaaaatatgtagatattaaggaggaaaaatagatatgagtatttggaatgatatgggaatggtatatgcacttcttggtgcggcagtggcagtattcctggcaggtgcaggatctgcgatcggagtaggtattgcaggacaggcagcgtccggagttgtaacagaagacccaagcaaattcgcaaaagtattgatcatgcagctgcttcctggtacacagggaatctacggattgctggttggatttattacattatctaagatcggacttcttggcggcggcgcagcagatctggatccgaagaccggacttctgattcttgcagcttgccttccaatcggaattgtaggtctgatttcaggaaaagcacagggacagacagcagcggcagcaatcggaatcgtagcaaagaagccggatcagttcggtaaagcaatgctgttccctgcaatggttgagacatatgccatccttgcacttctgatttctatcctttccgtaacagcaattcaggtatagaaggagtgtgaaggaaaatggctggattagagaagatcaaaagtcagatccttgacgaggcaaaagagtcggcaaatgtaaagatcgaagatgcgaaagcgcaggcagaacagatgaagactcaggcgcaggcagaaggagccgcacaggcagaacagatcctgaagaagtctgaagcggaagttgccgcacagaaagagcgtgtgaagtcggccatcgatcttcagagaagaacgagacttctggaagcaaagcaggagatgatcgcagagatcatcgagaaggcgtatgaaaaggttataagtcttgcgccggatgagtattaccagatgctcctgtctattctggaagcatacgtacttccgcaggagggagagatctatttctctgtaaaagatttggaaaatatgccggtaggatttggcaaagaaattgaagaaatagctctggcaaagggaggaaaacttactgtagccggagcgggcagagataatattgacaatggattcattcttgcgtacggtggaattgaagagaactgtacgatcagggcaatgttcgatgcgaagcgggatgaacttgcggacatcgttcaccggatgctctttgtatgatatggagggacaacatgagtgaacaatatacctatgcggtcgcaagaatccgtgccctggaagtatccctgttctctgacagtaccatcgaccagctgatcgcgtgccagagttatgatcaggcattgcagttcttagaagagaagggatggggagatactgaaagcagcggggatgcggaaaaaatcctgacaagagaagaagaaaagacatgggaagtagtcaaagacctgtcgatcggaatggaacattttgatgtgctttcttatccgaagctttttcataatttaaaggcagcggtcaaggaagtatgcaccggagataagaaccggcatatctattatgaagatgttcggattcccggggaagagatgcgaaagatcgtagaagacagagatttcggaaagcttccggacagtatgcggatcgcaggagaagaagcatacgagacacttctccataccggagacgggcagctctgtgacgtgatcatagaccgggcggcactggatgccatctatcaggccgggaaagagtcaccggataagatcatacaggattatgcagaatccacagtggcagtggcggatatcaagattgccgtccggtcacagaagaccgcaaaatcaacggaatttatgaaacgggcaatggcagaatgtgattctttaagtgtgagccagttatcgaaagcagcacttagcggtatggacgccatctgcgaatacttaagaggaacggcttatgcagaaggtgcggaagcactggcagagtcgccgtcagcattcgaaagatggtgtgacaatcggatcatccagacgataagcccggagaaatatcatgcatttacgataggaccggtaattgcctatgtaattgcaagacagaatgagattaaaacggtacgaatcattttatccggaaagcagaatgaactgccggatgattcgatccgggaaagggtaaggaaaatgtatgtataagattgcagtattaggcgattacgacagcatcttcggattcgcagcactgggccttgatacatttgccgtccagacccgtgaggaagccgcagagaaattacatcagctggcacagggtggatatgggatcatctatatcacagagaaacttgccgctgaattaacgcatgagatagaaaaatatcaggaacaggtcacaccggcgatcattcagatcccgggtatcgccggtaatacaggcgccggagttgcaggtgtgaagaaatcggtagagcaggctgtcggttccgatattatatttggcagctaaaggaggttgattcgtccgtatgagtacaggaacgattaaaaaagtagcaggaccgctggtcattgcagaaggtatgcgtgacgccaacatgtttgacgtggtacgtgtaagcagccagcgtctgatcggagagatcatagagattcacggagatgaggcatccatccaggtatacgaagagacatcgggacttggacctggagagccggtagagtctatgggagtaccaatgtcagtagaacttggtcccggactgatcacaagtatatacgatggaatccagagaccactggatgacattatgaagatttccggaaataacttaaaacgaggcgtggaagtcgcatcgttaaagcgtgataagaaatgggaatttgtaccggtcgcaaaagccggcgatgaggtcgaagcaggtgacgtactcggaactgtgcaggagaccatcgttgtacagcagaagatcatggttccttatggagtaaaaggaacggtaaaagagatcaaagccggaacatttaccgtagaagaagtggtagcagtgatcgctaccgaaaaaggtgacaaagaactgacgatgatgcagagatggccggtacgaaaaggccgtccgtatcagaagaaactgccgccggtaaaaccactggtaaccggacagcgtgttatcgatacattcttcccgatcgccaaaggtggtgtggcagccgttccgggacctttcggaagtggcaagacagttatccaacaccagttggctaagtgggcagaggcagatatcgtggtttatatcggatgcggagaacgtggtaatgagatgaccgatgttctgaatgaattcccggaactgaaagatccgaagaccggacagtccctgatggaaagaaccgtactgatcgcaaatacatcggatatgccggttgcagcccgtgaggcttccatctataccggaatcacgatcgcagaatatttccgtgatatgggatattctgtagcgctgatggcagattctacatcccgttgggcagaggcacttcgagagatgtcgggacgtctggaagagatgcctggtgaagaaggttacccggcatacttaggttcccgtctggcgcagttttatgaaagagccggacatgtggtatcccttggtaaagaaggaagagaaggtgcactttccgttatcggagcggtatctcctccgggtggtgatatctccgaaccggtatcacaggcaacccttcgtattgtaaaggtattctggggactggattccgcacttgcgtataagagacatttcccagccatcaactggctgaccagttattcactgtatgttgacaatatggcaaactggttcaacgaggaagtggcagcggactggatggaagaccgtcagaagatgatgacaatccttcaggaagaagccgagttaaatgagatcgtacagatggtaggtatggatgccctgtcaccgactgaccgtctgaagatggaagcggcaagatccatccgtgaggacttcttacatcagaactccttccatgagatcgacacttacacgccgcttcgtaagcagtatctgatgatgaaactggtactggcattttatgagaaatctgtcgatgcactgaacaagggtgcggacatgaatgcactgatcgccatgccggtaagagaaaagatcggccgttataaatatacaacagacgccgatatcgaaagtgaatataagaatgtagaagaagaactggacaaggaagttgcggctgcattcgggaaggaggacttctaaattatgccaaaagaatatagaaccatacaggaagttgccggacctctgatgctggtacgcggcgttgaaaatgtagcctatgacgaattaggtgagattgagcttgcaagcggtgagaagcgccgctgcaaggttctggagatcaatggaaatgatgcactggtgcagttgttcgaaagtgccacgggtatcaacttaagtaacagtaaagtacgttttctcggacgaagcatggagcttggtgtatcggaagatatgcttggacgtgtcttcgacggactgggccgcccaatcgacgggggaccggagatcctgccggatgaaagacgtgatatcaacggtctgcctatgaacccggcggcaagaagctatccggaagagtttatccagacaggtgtatcggctattgacggactgaacacattggttcgtgggcagaaacttccgatcttctcggcatccggacttccacatgccaatctggcagcacagattgcaaagcaggcaaaggtacgcggaagcaatgagaagttcgccgtagtatttgccgctatgggtattacatttgaagagtccaacttcttcgtggaatccttcaaagagacaggtgccatcgacagaaccgtactgttcgtcaatctggcaaatgacccggcgatcgaacgtatttccacacctcgaatggcactgacagcagccgagtatcttgcattcgaaaaagacatgcatgtactggtaattatgacagatattaccaactatgcagatgcgctccgagaagtatctgccgcacgtaaggaagtaccgggacgccgtggatatcctggatatatgtacaccgaccttgcaacgttatatgaaagagccggaagacagaatggcaagaagggaagtatcacactgattccgatcctgaccatgccggaagatgacaagacgcatccaatcccggatcttaccggatacatcaccgaaggccagatcatcttaagccgtgatttgtaccgtaaaggtatcaaaccgccgatcgatgtattgccatccctgtcccgtctgaaagataagggaatcggagaaggtaagacaagagccgatcatgcaaataccatgaaccagttatttgcggcatatgcgcgaggaaaagatgcgaaagaattaatgactatcttaggagaggcagctcttactgatattgacctggtatatgcgaaattcgcagatgcatttgaaaaagaatatgtatcacagggatacgataccgacagaccgattgaagagacactggagatcggatggaagctgttgtctatgctgccaagatcagagttgaaacgaattgatgataagttcttggacgagtattatggtaagcagtaagccatgcggattcgagtcggcatggcgtccaatatatataaagtatagaaaggagtgatactatggcgtcaacccaggtaacccctacccgtatggaactgaccagaactaagaagaaactggtcacagccataaaaggtcacaaacttctgaaagataaacgagacgaactgatgcgtcagttcttggatctggtaaaagtgaacatggagcttcgggaaaaggtagaagcaggtatccgttcggccaatcggaattttgtcatagccaaagccggcatggacgaagcgactctgaacacggcactgatggctccgaagcaagaggtagatctggaagtcggacagaagaatgtcatgagtgtagacattcctgtattcgagacgaagaccagaacggcagatgcgaatgatatctattcgtatggattcgcatttacatcgagtgatctggacggagccgtaaaatctctggcagatatcctgccggatatgctgaagcttgcagagacagaaaaagcctgccagcttatggcggctgaaatcgagaagacccgaagacgtgtcaacgccctggagcatgtgatcattccggaagcacagaagaatatcaagtatattacgatgaaattggacgagaatgaacgaagcacccagatccgtctgatgaaggtgaaagatatgatgctggaggaagcgcatcattacaaagagaaggagtaaaagcctatattgaagaaatccgcagggataagccttccagcttgcatctgcggattttttgctatgagtttataaagagttgtagaaagttcacaaaaaatcagcattttcaaaatgaatattgaaaataaaaatcaggcatgttattgtatcgatacgcagatgaattctaatatctgcactgtatctatagttaccattcatttatttcagacccagataatcgggaaagaatctaaaatgaacaatacaacaaacagataatgcatgcctgataaaagaagttggctgtgtatactggtatatatataaactctgtgttatcatatccataaagataaacagctcttctttacagggaacatccagagttggtaccatcagagctgatagaacttttgaagtatatgcaatatagtacagatgaagtgtcaggggcatgcgaaagtaaacggattcaagaaatgcatagacgtgtttgtcagattagagcaagtgagaagacagaggtgaagtatatgcagacgtgggaagaaaagatacagaacgaaaaagctgctgaaggataatggtgaaaggctgctgctgtagaagtacagggcagctttttgcttgtatcaagataagaaatattaagaaagttgttatagaatcgctcaaaagaatagagtataatcaaaattaagaaattacgaaaagaggatcggcctatgaaattaatgacagaatctatctatatcggacatgacatgaagcggttcaacgagatccgggatgcgctggatctggcgaagattccatacaaacataaagtaagaaatcaggactcagagtggctttttcagggaaaaggaacgaagagatcccaatttggaagtatcggagtagatcaggataaggcatatgaatatgaaattctggtgagaaaggaagataaagcaagagcagaacatgagattatataatgcaatcatgaagcattttactcagaagattcttggaaagatgaaagagttgtagaagttttataaaaattgagcatttctaaattacatattgaaaataaaataaggaatgttattctaatctaaaaataggagctttatttaaaaatatactctgttttaggaggtgcctcatgttaaagaataataaaatcaaaatattatgtctgctcataatcggaatcgtatttttgtatatatatggaccaattgccttcatgaaagatggattagtaacgagacagagtgtaaattcttttgatgaattatacgagctaggaccagcacgccggcataaatgtgaaaatggtacacgtatttatattgtatattttggatggtctgctccaaaagttaaaaaagaaatagtatatcaaaagaatgaagaaacacaaaagcaaatagtggatgttgatacgcaaaaaattattccgggattatattatatttcatgggatacaaaaagttctgtatacagaattgaaacaagaaaaaaatattattttgtaataccttattgctaaggtgattaacattatcaaaaaaggaaatagtaaaaaatacattgattaatatttattgatatgttaatatgtaccaaagcatatttcaaaaaaatcaacggtatataaaaacggacatataccatctataatctaattttatttcagaaatctatgctttcataccaatcaattgtaaaaaagcaggagatgactgaaagagtaaaaagacatcctcctgcatacaggaggaaactgaatatggcgaaaagaaagaatcaaaagagacggagcaagaagtatcaggtgaataaccggcagttaaaggcaaaaaggatgtacaaggatacaatttttagaatgttgtaccatgacaaagagaatttgttatcattgtacaatgcggtgaatggaagagagtacacagatccggaaaagttgcaggttgttacattggaaaatgcgatttatatgggaatgaaaaatgatctggcgtttatcatggatatgaatttatatttatatgaacatcagtcaacgtataatccgaatattccacttagaaatttgttttatattgcggatgagtatcaacgattagtggttcggaaatcattatattcaactgtgatacaaaagataccaacgccaagatttttagtattttataatggaacaaaagaagttgaagatcgtagtgagttccgattatcttttgcatacgagaatccaacagaaaatccagatctggagttaagagtgactatgctgaatgtgaatgatggccacagttcagatttgatggaacattgtagaacattaaaggaatatgcacaatatgtcgccagagtaagaaaatatgcggcgaaacaggatgtctctttagaagaagcagttacgagagcagttgacgaatgcatagaagaaggaatcctggcagagtttttattgaagaataagactgaggtgatcaaagtgagcatctatgaatatgacaaagagtttgaagaaaagaaactgcggaaagcagagtttgaggctggaagacaggatggaatcgagattggaagacaggatggaatcgaaattggaagacaggacggaatcgagattggaagacaggatggaatcgaaattggaaagcggatactcttagaaaaaataataaagaagaaattgaaaaaaggaaaatcaacagaacagatagcagatgaattagaagaagatataaacataattcaaaaagtggttgagaaattaaaaagccaaatatagaatttgtcaaaagaattccctgaagtgaataataaaacttcagggaatttatcatttgctcactaccggtattattctgtagtatcacgtcggatcaatacaggcgtaatctgcttatgaaccggctcttttaaaggagttggttttctttttttcatttcattcatctggagaaccagaagctccatggcagtctgtgcaattttctcaatttgctgtccaacggttgtgattggaaggatggcttcgcttgcaataggagaatcatcgaatccgacaatctgataatccttcgggagttttccgtatttctggaatatcaggtttaggaacatactggcataagtgtcattcgcaagaaagactccctttttttgtgccggatatttctcttcaatttcattaaatatattctttagctgagctaaagtttcctgataagtgtttcccatatttctttggatcagttcatgagtaatatgatgctcattacagatatcttcaaatccctgaatacgcccataagtcgggagggtatcagaaaatatggaattgatatgtaaaatgacatcacagttattacgtatcaacaaactggttgcctgaacaccacccagatagttgtctgtagacacgctgcagacatggtcacattcccgctcaatcgtgacaaccgggagtttataagaagcaagttcttcagacgaaatggtattgcttaagacaataagtccctcaatcttataagccatcagttcatgaatatatttttcttcaatctcttttttattatttccaatgaatacaagaaatttataattatacttttcgtaagtagaaagtaactggtttaacatctcagagtaatagtgaagatacaggttggggatgataattccaacaaattcactttttccattagccagtactttggcgagcttattttcctggtatccaaggacatccagtgcatgagtgattttttcctgattttcaagagtcagagaatccggattattaaaatatctggaaatggtagtttttgaaaagcctgtataagcggctatatctgcaaaagttacttttttctgtttcatgtaaatcctcttccttataatgtatattatcagtatagcaagtgcattgaaaaaaatcaaacaaaaaataactagttaagtaaccggtaactttttctttgaaatctattgacaagtaagattcaggatagtattatgaacatacaaagtaaccggttacttaactggttacgcaatcgtgaatctgaaaggagaaagctatgaagaaacgaacagtaggggtactgctggcagcattctttgcaatggcattgacggggtgtggggataaacagccgcaaccaggagaagtaaagggatatgacaaaggcgaagaatatctttctatctgggtacattcaatcgaagacacagaagaaggacagtgctacaggaaatctgtagatgcatttaataagaaatatgatgggaaatattttgcagatattgaatttattccacgaaatgacagtggtggaggctattcggataagatcaatgcatccgtgatgtcaggagatctgccggatgtgcttactgttgatggccctaatatagcggcatatgcagagaacggaattatccagccgcttgcaaaattaacagacgaagaaaagagtgtgtatctggattccattattcagcagggaacgtataataacaagctctatgcgcttggagcaatggaatccagcgtgggactttattataacaaagatattctcgcagaagcgggtgtagaagttccagatgcagatcacccatggacatggagtgaattcacagaggtgttaaagaaagtacagccggtagtagagaagaaaaaaggttatgcgctggatatgactttcccgacaggagaagctacgatttattattatgcaccgtttttctggtcaaatggcggtgactttgtaagtaaagatggactgaaggtgaacggtgtattcaattcaaaagagaatctggaaacagtgaattattttaaatcgtttttggataatggatatatgtcaaaagtacagatcacagacctgttcgaaagcggaagatatacaccaaccggttcctgggcatttgcggcatcatcaaagacgaagaaactaaaaggtgcgacaaagctggtacagtggatgagtggtgtagaaagtggaaagcgtctgtgggatgaaagtaagagtttcccatctacatatgaagcgtttgagagcagtccgatttttgaagaagatgagaattataaagccttatatcatcagctgagtaaatatggacatccaagatcaaaaacacctgtatatccacaggttagtgcatcggtacaggaagtattggaaaattcggtgcttaccgataaagatgcgaagacagaactggataaatctgtagaaaggattaacgcaaaattaaagcgttatgtgatgaaataatgaagaaaagaacagaatccattatgggaatggcgttttttggaccggcacttgtgttacttacgatatttttattcctgccaatgatcctgacattgattttcagttttactgatttctttgctttaaatccgggactgacgcattttgtcggactggacaactatattcagatttttaaagatgatgtgttttcacaggcattttttaataccgtaaagtttgtgatcattattgttccgctgcagggaattggagcacttgtgctggcacttctgattaataaagtgacgcattgtaagaagtatttcaaagtagcattctttgttccggtggtcatgtcacttgctgttgtgtcaacactgtggatccagatctacagcccggaaggaattatgaatgcaatcctttctttctttggaattgatgcacagccattcatcaacagtgccagtcaggcacttccatccatcgcgatcatgagtgcatggcagggaatgggatatcagatgatcatcttcctgggaggaatccaggcaatcaatccggcactttatgaagcggccgagatggaccatgcaacaccgtggcagagattcaaggacattaccctgccggaattgaaaccattgtgtgtgttcgttttaattacgattacgatcggagcattccgtatgttggtacagccaatggttatgaccggaggaggaccatcgaattcaacgtatacggttgtgtatgatatatatgaaacaggtactgttaattgggaaattggactggcatctacaatggctattgtattcgcattctttgtaatgatactgaccgtgatccagacaatcgcaacaagagataaggaggatcagaatgttaacaaaaaagcaaaaaagaaataattggatactgacggtcgtacttctgatcgtatcattgttgttcctgttcccggttatctggatgctggcaaattcattcaaaccagacgcggcaatcactgctgatatgaacagtatggcggcattcattccaccggcattgaacggcaatttctttgaaaattatgtatctgtattaacaaatacaggatttgtacgatacatgtgtaataccttgttctatgcagcaatattgatcgtacttggtgtaattgtaaatggactggcaggatatgcattggctaagattaattttccattcagagaacgctggcttctgatcattatgcttctgatgatcgtaccgatggagacgatcattacgatacatttcctgatcattgcaaaacttggacttctgaatacggtgcttggatatgtacttccaatgattgtgaatccgtttaacattttcctgttccgtcaggtattcctgggacttccggatgatgtatatgaggcagcacagttagatcactgtggaccggtaaaatacttttttactatggttcttccaatgtcaaagagtgtagtggcaacggttagtgtatttacattcctgaatgtatggaatgattatctgtggccgtcacttgtatttacatccagtgatcttctgacggcacagattggtctgaatgcgattacatcaaatgataacacaacaacaggacagacccttgcagttatcacaatggtaacaattccggtcattattatctattcactcttctcaaaacagatcgtagagggtgtaatatcaacaggttccaaggagggctaaaagatgagctttatcgaatttaaaaatatatgtaaaaaatatgcaggaaacgataagaattccgtgacagactttaacttagatatagaagaaaaagaatttatcgcatttgtcggaccatccggatgtggtaaatccacaacactccgaatgatcgcaggatttgaagagattacaagtggagatctttttattgatggaaaacgtgtgaatgaggttgcaccggcggatcgaggaatctctatggtgttccagaactatgcactgtatccacatatgacggtagaaaaaaatatttcttatggattgaagaatatgaaggttccggcagatgagatcaagaaaaaagtagactgggcaattgatatcctgggactcgaagaatatcgttaccgtaagcctaagaatttatcaggtggacaaagacagagagtggcacttggaagagcgattgtaaaagaccagaaagtctttctgatggatgagccactttctaacctggatgcaaaactgcgtgtcagcatgagaaatgagatcagcaaattacatagaaatcttggaagtacaaccatctatgttacacatgaccaggtagaagccatgacaatggcagaccgcattgtaatcatgaaagatggcgtgatacagcaggttggaaaaccgatggatctgtacgaacatccggtgaataaatttgtggcaggatttatcggctctccgcagatgaacttctatgatgtaaaaatagacggaagaaatctaatcttcaaagatggaaataagattgaacttccggaagcaattgcaaaacgtattgcgggatactcagaagttatcatgggaatcagaggagaagatatcaagtttgatacaactaatctggatgtctatggaagtcatcagaaagcagttattgacaatacggagattatgggaaatgagaataatctgtattttgacttcggaggaagcgtaacgattgcaagagtatcaaaatatgaagtaagccaggtgggagatgaggtggaatttacctttatgccacataagatgcatttctttgataaggaaacagagcaggtgatcggagcagaataatttagaataaaagaggaagaacgtatgcttgaaaaagccaatgaatatatcagacggaatcacatagatgaaaaagaaaaatcattattccatgtgacaccggaaacaggatggatgaatgacccgaatggtttctctgtatatcagggaaaagtacatttattctatcagttctatccgtataaaacagaatggggaccgatgcactgggggcatcaagtgaccgaagatctggtaaaatgggaagcatatccggtagctatggcacctgatcaggattatgatcacattggatgtttctcgggaagtgcagtagaagctgatggaaagcatgtgctgctttatacaggagtaagccagaaagacggaaaagaaatccagaatcagtgcattgccattggagatgggaagacttatgaaaaatggcaggataatccagttataaaaggagatatcatgccggagaaatttgacagaaaagacttccgtgatccgaagatatggaaaaaggatggcagatattattgcgttgtaggcaatcgctatgaggaaaattgtgggcaaatagtcttatttagcagtgcggactataaaaactggcggtatgaaaaagtccttttgagaaatgacggaaagaatggagatatgttagagtgtccggattatctggaagtagacgggtatcctgtaatcatttgttctccgcagaatatgcatgctcaaaagtacgaatttcataacggtcataattccatttatattattggagatgcagaaaaagaaatatcggattttgcatgggagaaaaagagaagcctagattatggactggacttttatgcaccacagacaacagagcttccggatggcaggcggatcatggtcgcatggatgaagtcgtgggatgcacgtgtcatgacaaaaggacagaaatggcagggaatgatgacactcccaagagaattaaaaatcaaagatgggaaaatctggcaaagtccggtgagagaactggaaaagtataagaaaaatccaatcatctatacagaacagaaaattagcggacagatgtctttggatggtatcaatggccgggtgattgacatgacggtagaacttacgaatgtagaaggccgggagttcaaggtagatgtggcacataatgaagaatatacaacaacatttacatattatccggaaaaacatcagattgaaattgaccggacctacagtggtgtaaatgcagatgttgtctgtgtgagaaagatagaaattgcggaaaaacatcatgcgccgaaactacattttatcatggacagatattctgtagaattatttattaatgatggagagcagacggcaagtgtggtcattcctacgccattggaagcaaatgaaattatatttactagtgatgaagcggcaaccgttaatattgaaaaatatgagataacattcaattagaagagatagtttctcattcaccgattgatgtccccgtgcatatcttaatacagatagaaccgccaaggagcaatcaggattatggagaacaaattaccgttctatatggcttatccggttccgctgctgtataatgatgaccggaatgcgagaagagactatgactatatgaaaagcatttacccggatacggcgaagagagtacttccttatatggaagaggaatgtgacagaatggaatatgatggaagtatgatgtatgatgaatatccggaccgcctgcagcttcgtctgatgtgccgcaggatctatgataaggcgaagaaggaagaagagaacccgggtgcctggcttatggatctgatcgaggttatgacatatcaggaactttgcaggagacgtgtagaacatagagagatacgtaaaaaaatatattgatctacaagagggcatctggaaaaaaacttccacttcgccctcttgtatgttatactgtgcggtgataaatgaatgttttcagatgaaaaagtcagaacataacatacaggagggcacatcatggcagataataacattatttttatcggaatgccggcagtcgggaaaagtacagttggtgtggtaattgcaaagagactgggatacagatttgtagacacggatattctgatccaggaatcagaaggaaaacttctgaaagatattattgctgacgttggaccggatggcttcctgaaagtagaagaccgggtcaatgcacaggtgaaagcggaacgtaccgttatctcgccgggaggcagcgtagtatattgtgaaaatgcgatgaaacattataaagaaatcggcaaagtcgtatatttacaggcatcctttgagacaataaacagcagacttaaaaacgccaaaggccgtggagtggtactgcgtgacggacagacgctcaaagatctgtatgatgaaagagtaaagctttttgaaaagtatgcagatattacagtgtgtgaagataatcagaagctggaagatacgattgaatcggtattagatgcattaggggagtaaaagtgcacaagtatagatagaacaattgaaatatgttacaataaaattacataactgtaaaaaatattttacaattgagaaatttgtgctataataggcgcgaacccttttggggttatattgtgatgcagaaatttatgtacaatttgagatagttataaatattgaacaaaagatttattgtaattagagattcatataaatattaatgaggtgtaattaatggaacagtatattattaagggcggtcatccgcttgtgggagaagtggaaatcggcggtgccaagaacgcggcacttgcaattcttgcagcagcaattatgacagatgagaccgtattaatcgataacttaccagatgtgaatgacattaacgtactgatcgatgcaatcgaggggattggagcgaaggtacaccgtgtcgaccgtcatacagtaaagattaatggagccagtatcaagaacgtagatattgagtatgattatattaagaagatccgtgcttcctattatcttcttggcgcattacttggaaagtataaacgtgccgaagttgcacttccgggaggatgtaatatcggaagcagaccaatcgaccagcatctcaaaggattccgtgcgttaggtgcagatgtagatattgaacatggcaagatcgttgcagaggcagaccgtcttgtcggaaagcatatttatttcgacgtggtaagtgttggagcaacgattaacgttatgatggcagcagctatggcagaaggacttaccattctggaaaatgtcgcaaaagagccacatgttgtagatgttgcgaacttcctgaacagcatgggagccaacatcaggggagcaggtacagatgtgatcaagatccgtggtgtacagcgccttcacagaacagaatattctgtgatcccggatcagatcgaagcaggaacattcatgttcgcagcagcagcaacaaagggagatgtaacggtactgaatgttattccgaagcatctggaggctacgatcgcaaaactggtagaaatcggatgtgaagtggaagaattcgatgatgctgtacgtgtcgtatcaaaaggagatcttacaagcacacatgtgaagacccttccgtatcctggattcccgacagatatgcagccgcagatcggcgtaacactggctttatgtaaggggacaagtatcattacagagagtatttttgaaaaccgtttcaaatatctggatgagcttgcaagaatgggtgcaaatgtgaaagtagaaggtaattctgcaacgattgaaggcgtgacagaattttcgggagccagagtgagcgcaccggatcttcgtgcaggagcagccctctgtatagctggtctggcagctgacggaatcacaatcgtagacgatatcgtatatatccagagaggatatgaaagattcgaagagaagctccgtggtatcggcggaatcatcgaaaaagtagattccgaaaaagcaatccagaaattcaaattaaaagtaggctagatgatacattttcttaggtatgtctattgacagtatgtgtaaaatagagtaaagtcttagtcgtaccagaaatataataaaagcaaactttctcttattcagagcagtggagatacaaaggatctatgaaactgcggcaaccccatatatggaaggtgccagcctgagcgagtgatcgaacaataagaggattggtttatgaagatatcaaaccgtccacttatgtaagtggacggtttttcagttcggtaaaacagggaaatctaaaaaaactgccggcaatcctgggagaaagaatgcaggaatgttttaagaaaaaaggagagaagaacgtggaaagaagattatttacgtcagaatcagtaacagagggacatccggataaaatgtgtgatcagatttctgatgccattctggatgcattgatggcacaggatccaatgagccgtgtcgcatgcgagacagcaactacaacaggtatggtacttgttatgggtgagatcacaacgaatgcatacgttgatatccagaagatcgtacgtgacacgatcaaagaaatcggatatacaagaggaaaattcggattcgatgcagagacttgcggtgtgatcacagcaatcgatgagcagtcggctgatattgctatgggtgttgataaagcactggaagcaaaagaacatacaatgtccgaagaagagatcgatgcaatcggagccggagatcagggaatgatgtttggttatgcttctgatgagacaccggaatatatgccatacccgatcgcactggcacacaagctctcaagaaagcttacagaagtaagaaagaacggaacacttccgtacttaagaccggatggaaagacacaggttacggttgaatatgatgagaatggtgttccggcacgtctggatgcagtcgtactttcgacacagcatgatccggaagtgacacaggatcagattcataaagatattaagaaatatgtattcgatgcaatcattccggagggcatggtagatgagaagacaaagttcttcatcaacccgacaggacgttttgtaatcggcggaccacacggagacagtggacttacaggacgtaagattatcgtagatacttacggtggaatggcacgtcacggcggcggggctttctctggaaaagactgtacaaaggttgaccgttctgctgcttatgcagcacgttacgttgccaagaatattgttgctgcaggacttgccaagaaatgtgagattcagttgtcttatgcgatcggtgtagcacatccgacgtctatcatggtagatacattcggaacaggtgcagtagaagatgataaactggtagagatcgttcgtgagaattttgatctccgcccggcaggaatcattcagatgcttgatcttagaagaccaatctacaaacagacagcggcttacggacatttcggacgtacagatattgatcttccatgggagaaactggacaaagtagaagatctgaaaaaatatttatagaaattttataaaagtttatgggtgctttggtgtgaagcacccatttttcatgctataattttttttagtggaggacagatacatgaagctgaaaacgcgattagttatagcattttttacgattatcattataccggtccttatggcagccatgatggtttcaatggtatgccgctatcagatcggagtggtggagaagaattatgggattacaggaacgacgatttctgattttacgaattccatgcaggtacttgcacgtgttacggagaagccgtatcatgaactgaaggatatgtcagaacaggcatctgagatggaagatgcgacagaactggatcagtttaataaaaaactggagaataagaatgcatacctgctggtgagaaaagacggaacaatcgtatatacgggcagcgatgatgatcgtgtaaaagcggtgatcgaacaattgccgggatatggagatacagatacaacatcggagaacggaatttatcttggcggagatgcagaagcattggtaaaacaggtagatttcagatatgatgacggcaataagggaagtgcgttcattgtgtcagatgtatccaatgtaattccggaggttggacagtttttctgcgaaatcctgattggaattgtagtgatactgatacttacttcggcagctcttattatatggatttaccgtgcggttatggggccgatcggcaagatgcagacagcggcgcagaatatcaaggatgggaatctggattttgagttgaaaccggaggctgacgatgaacttggaaaactctgccaaagcttggaagagatgagaggacacctgaaggaaagtgccgaagaaaaattgaaatatgacaaagaaagtaaagaactgataagtaacatttcacatgatctgaagacacctgtgacaacgatcaaaggttatgccgaaggaattatagatggtgttgcagatacaccggagaagatagaccggtatgtcagaacaatctacaataaagcgacagagatgaatacgctgatcaatgagctgacattatattctaagatcgatacgaataagatcccttacaattttaatatcgtgtcggcgaatgaatatttcaacgactgtgcggatgacctgtcggttgaactggcagcacagaatgtaggatttggttattttaattatgtagagaagaatgtacggatcattgcagacccggagcaggtaaaacgtgtgattcacaatattgtcaacaattcgttgaaatatatggacaaaccaaagggaatgatcaatctgcgtgtcaaagatgtaggagattttgtacagattgaactggaagacaacggaaaaggaattgcggcaaaagacctgccgaatatctttgaccggttttaccgtaccgacgcatcgagaaattcttccaccggaggaagtggaatcggtttgtctgtagtaaagaagattgtagaagaacatggcggtaagatctgggcaacaagcagagaagagaccggaacgacaatgtattttgtactaagaaagtatcaggaggtaccagtcaatgagtaagatattaatagtagaagacgaagaagcaattgcagatctggaacgggattatctggaactgagcgggttcaccgtagaggttgcaaatgacggagatacaggacttcagaaagcactgaacgaagattatgatcttctgatcctggatctgatgctgccgggaacggacggattcgatatctgccgtcaggtgcgtgatgtgaagaatacaccgatcgtgatggtatctgcgaagaaagatgatatcgataagatcaggggactgggactcggtgcggatgattatatgacaaagccgtttagtccaagtgaactggtggcgagagtaaaagcgcatctggcaagatacgaccgtctgaccggaagtgcggcagagaagaataaagtgatcgagatcagaggactgaagattgatacaactgcaagacgtgtgtgggtgaacggagaagaacgtacatttacgacgaaggaattcgatctgctgacattccttgcgagccatccgaaccacgtatattcgaaagaagagttattccgggagatctgggatatggagtccatcggggatatcgcaacggtaacggtgcatatcaagaaaatccgtgagaaagtagaagtagatacatccaacccgcagtatatcgagacgatatggggtgttgggtatcggtttaaggtgtaagtaaaaatgtagcaaaatattttgagatgcaaaacccccagaggtctggtacacctccggggggtttttattcaatggaggatatgatatgataatgtaaataaataagaaacacgaggaacaacatatatgatcacaagcacatccaacgccagaatcaaacgtctggtgaatttaaagaagaagagaaaattaagagacgaagaaagcgtcttcctggtagaaggaatccgtatgttcagggaagtgccgctcgacaagttaaaagaagtctatgtatccgaatccttttacaaaaaagaaaaagataccgtaaaagaagtcctgaaagactctaaagtaagagtggaagaactgacagatactgtattcgcccatgcatcagatactaagacccctcagggaatcctgtgcgtggtggaacagatgaaccatgaaatcaatgaactgacttcggcaaaatgcccgctgatcatggtattagaccatctgcaggatccgggcaatcttggaaccatcctgcgtacagcagaaggagccggcgtgaccggcatcctcatggacagagaatgcgtcgatgtctataatccgaagacaatccgctcaacgatgggatcgatataccgcatgccgttcgtatatgtggaagatcttggcaaaggaatacaggatttaaaagacaaaggtatcaccacttatgctgcacatctggaaggaacgaattcctatgatgaggaagacctgacgaatccatgtgcattcctgattgggaacgaggggaatggcctgagacgcgagatcgcagacatggcagactgctatgtcaagatcccgatgcttggacaggtagagtcattgaatgcagcaatcgcttcttcggtgttgatgttcgaagccgcaagacagagaaggaaagtgtaattaaatgagatacaatccactcattttacagaagaaaattgctttctttatcagagtatagtaatatagtgaacaagaaataatatatacggaaaagagaggacggcttatgagagtgatctattggctggcaatattcattgtattgttgatcattgaaatcgcgacaatgggacttaccacgatctggttcgcaggaggagcactgatcgcattctgtgcaggacttgtcggttttgggctgggagtgcagatcggagtatttgttatagtttccattctgcttctgattctgacaagaccgatcgcggtgaagttcttcaatcaggagagacagaagacgaacgcagagagtctgatcgggcagcatgcactggtgacagaagatattgatacgataaaggcaaaagggcaggtagagatctgcggtcagatatggtcggctaagacggatgagccggacggaaagattccaaagaacacagttgttgtagtaaatggtattcagggcgtgaaactgatcgtgcatgccagagaggagtagagtatgatttttggattgattttattagtgattattatctgcgtggtgatttcctgtgtaaaggtagtcagacaggcgcaggcattggttattgaaagactgggggcatatcaggcaacatggggaaccggacttcactttaagattccgatttttgaccgtgtggcaagaagagtggatctgaaagagcaggtagtggattttgcaccgcagccggttatcacaaaagataacgtaacgatgagaattgataccgttgtattttatcagatcacagatccgaagatgttctgttatggtgtggcgaatccgatcatggcgatcgagaacctgacagccacgacacttcgtaacatcatcggtgatctggagttggatcagacactgacatccagagagacgatcaacacgaagatgagagcatctctggatgtggcaaccgatccttggggaatcaaggtaaaccgcgtggaacttaagaacattatcccaccggcagccatccaggatgcaatggagaagcagatgaaggcagaacgtgaacgccgtgaagcaatcttacgtgcagaaggtgagaagaaatctacaatccttgtagcagaaggccacaaagagtctgcaattctggatgcggaagctgagaagcaggcggctatcctgaaagcagaagcacagaaagaagccacgatccgtgaggctgaaggtaaggcagaagccatcatgaaagtacagcaggcaaatgccgatggaattcgtttcctgaaagaagcaggagccgatgaggctgttcttaccatgaaaagtctggaagcatttgcaaaagctgctgatggaaaagcaacgaagatcatcatcccgtcagagatccagagcattgcaggtctggtaaaatctgttacagagattggcgcagatgataaaaaagaagaaaagtagacaaaagacataagataaaagtcaaagaataaaaacgaggtacaaaacaatggatttaaaaggcagaaatttcctgacactgaaagatttcacaccggaagagatcacatatctgcttgatctttccgcagaattaaaagaaaaaaagaaaaaaggaattccggttgataaatacagaggaatgaatgtggcattgatctttgaaaagaccagtaccagaacccgctgttctttcgaagtagctgctcacgatatgggtatgggaacgacttaccttgatccttcaggttcacagatcgggaagaaagaaagtatcgaagatacagcaagagttctcggaagaatgtttgatggaatcgagtatcgtggatttggacaggagattgtggaggaactggccaaatatgcaggcgttccggtatggaacggactgacgaatgagtatcatccgacacagatgctggcggatatgctgacgatccgtgaacattttggacatctgaaaggtatcaaactggtatacatgggtgatgcaagatacaatatgggcaattccctgatgatcgcatgtgccaaattaggtatgcattttgtggcatgtacgtctaagaactatttcccgaatgaggaactggtagagacttgcaaaggatatgcaaaagagacaggagcaaccatcacactgacagaagatatcgaaagcggaaccaaagatgcagacgttatctgtacggatgtatgggtatccatgggtgagccggacgaagtatgggaagaacgtatccgcgaactgtctccatacaaggtaacaaagaaagtaatggaaaatgcaggagaacaggctatcttcttacactgcctgccggcattccatgatctgaagacgaagatcggcaaacagatccatgacaaattcggactggacgatatggaagttacagatgaagtattcgagtctccgcagtcaaaggtatttgacgaggctgagaaccgtatgcatacgatcaaggctgttatggtggcaacacttggtgaaagagagtaggcaagagcagacagagtatgaaatcagaaatattacgtttgttaaaagagaatgatacatatatttccggacaacagctgtgcgaacagttccaggtgtccagaacagccatctggaaagtgatcgatcagcttaagaaggaaggctatcagatagaggcggtgcgtaacaaaggctaccgccttatcgaaagtccggatgttatgtcaaaagcagagatcgacagtctggtagatacaaagtgggcaggaaagaacgtcatatattatgatgagactgattccacaaataaccgggcaaaggaagccggaaataataaggaacctcatgggacattatttgttgcagatatgcagatggcaggaaaagggcgaaggggccgcgtctggaaatcgccatccgggagcagtatctatatgacgatattgctgtatccggatatttcgcctgtaaaagcgccacaacttacactgatcatggcgattgccgtggcagaaggaatccgggaggttaccggtcttgagacaaagattaagtggccgaatgatatcgttgtgaatggaaagaaaatctgtggtatcctgaccgagatgagtacagagatcgattacatcaatcatgtagtgatcggagtgggaattaatgtgaatcaggatacgttccctgatgatattaaggaaactgcctcatcacttaagatggaactcggaaagcgcataaagcgttccgggctgatcgcagcagtaatgaaaaactttgaaaaatattatgagatctttcaggagacagaagatctgtcaggattgaaggaactttataattccatgctggtgaataaggaccgggaggtcaaggtcctggaaccggggaatgaatataaagcatatgctatcggcatcaatcagactggagaactgattgtaagaacgccggatggaaaagagaaagaaatctatgccggagaggtatcagttagaggagtatatggatatgtatgatggaaaagtagtgctttgcggtgctaattcatatgaagaaaagtattatctgaatccggattttgaacagcttccggatgacgtgaagaatgaactgaagattatgtgcgtattgtatgtgcatgacgtagggggaatccttacgctggtgtttgaagaagacggagaattatgttttgaggtatcgaccgaggaattcgatccgatgttcgatgagatcggaagccagcttaagatcaagcagctgcagagagagaaacaggatcttctgcaggcattgcagttatattataaagtattcttcctgggtgaagagataaacagcgaagagtaactagaaggcagcagacaaaacaggaggagaaagatgcttcttgtaatcgatgtaggaaacacaaatattacacttggtgtgtttgacaaagaagaattatttggtacattccgtatgaagacaaagcagccgagaacatcggatgaatatggaattactttacaggaactcgtagaaagacatgggattgaaagttccaagatcaatgcagtgatcattgcatctgtagtaccggatgtgatgcattcactcggcagtgcgatcatcaaatacttcggcgtaaagccggtggttgtatctgctggaattaagactggaatccgcattgtcacagagaatccgagacaggtcggtccggaccgcattgtagatgcagtcggtgcgtatactttatacggaggtccaacaattgttgtggattttggaacagcaacaacatttgacgtgatcggtccggacggaacatttgaagcaggtgtgatcgcaccgggaatcaggacttcggcacagtctctctggggagaggcagatatgcttccggcaatagagatccgcaaaccgaaatcaattcttgcaaaagagacaattacggcaatgcaggccggccttgtatacggacaaatcggtcagacggaatatattatcagacgaatgaaagaagaatccggatatccgaatgcgaaagtagtggcaaccggcggacttggcaagataattgcaaatgagaccgatatgatcgatgtgtatgattcacagcttacgttaaagggacttcggttcatttacgaaaaaaataaaaaaaataaataatctgcagtgttgacagtgtagacttgcaaagaaatatgcagcactatatatcaagaaagcttcgtttatgaatgttaggggctgtcttatctgatatatagtgctgtgtgtttcttgaaaaaattacagataattgtaatctgagtgtgataacaggagtagaaaaatgaaaatcgggaatgttaatctggcaaatccatatatactcgcaccgatggcgggagtaacggatctgcctttcagacttttatgtaaagaacagggagcagggcttctctgtatggaaatgatcagtgcaaaagctttgcaatataagaataaaaatacaaaagcattgctggcaatccatccggatgagtatccggtgtcattgcagctttttggatcggatccgaagattatgagcgagatggcaaagatgatagaagaactgccatttcagatcctggatattaatatgggatgcccggtgccaaaagtagtgcggaatggagagggatccgcacttatgaagaatccagagctggtacatgagatcgtatcggcagtatcaaaggcaattaaaaagccggtaacggtgaagatcagaaaaggattcgacgatgataatatcaatgctgtggagatcgcaaagattatcgaagatgcaggaggtgcagctgttgcagtacacggacggacaagagaacaatactattccggaaaagcagactgggatatcatccgtcaggtcaaggaggctgtatccattccggtgattggaaacggtgatgtgacttccggagagatggcacttcagatgagaagagaaacaggctgtgatggtgtgatgatcggaagaggtgcacaggggaatccatggatattccacgaactccaggaatacgaaaggaccggtgttgttccgccgagaccgactccggagaagatcaaagagacgatgctaagacatgcaaaactgcagattgaattcaaaggagacttcatcggaatcagggagatgcgtaagcatgtcgcctggtatacaaaaggaatgaaaggttctgcaaaactcagggatgcgatcaatcaggtggaatcttatgaggaattggaagtacttctggacaaagcaatcgtataatgtacaaaaatgctgaaaataaaggaaaaacgggtacttgcaggtgataaaaagattgacataaaacatgcatttatgtataataatgaaattgtgaaagtatcattattctatgacagattaattattcagatagatgattcaggcataaaaatgtcagagtaatatggaacagaaaaaggagcaggagacagatggaagcaaagaaaaaattacttacttatgctggtttaaaagcactggaagatgaacttgagaacctcaaggttgtaaaacgtagagagatcgcccagaagatcaaagaagcaagagaacagggagatttatcagagaatgcagagtacgatgcagcaaaagatgaacagagagacattgaagcacgtatcgaagaactggaagcaattcttaagaatgcagaagttgtagtagaagacgaagttgattttaataagattaatatcggatgtacggtaaaagtattcgacatcacatttgatgaagagatggaattcaaactggttggttctacagaagcgaacagtctggaaggaaagatttccaatgaatcaccggttggccaggcattgatgggcaaacagatcggagatgtcgtaactgtagagacgcaggctggagtaatggagtacaaggtactggatatcagccgttcattataacattataaaataagagacagacgggcatccgtcgaagaataaccagaatacatgactcaggcctctctcacacgggaggtctgaattcggataaggaaggagaataaaaaagtggctaagcagcagaacaacggacaggaacaggacgtgaaccagttaagaaaggttcgacgtgagaaattagcagaccttcagcagaatggaaaagatccatttcagattacaaaattcaatcagacacatcactcattggaagtgaagagtctgtatgaagcacatgaagcagaacttttaaaagaccaccagacaccagacgtagagggaatggatgaagaacaggcaaaagaggttctgaagaaagattatgaagagagaagaagcatcatggatgccaatccaatccacgtagcaatcgcaggacgtatgatgttcaagagagttatgggtaaagcttctttctgtaacattcaggatcttcagggaagcatccaggtatatgttgcaagagatgcgatcggaacagactcttacacagattttaaacgttctgatattggtgacattttcggattagaaggatttgcgttcagaacaagaacaggagagatttctatccatgcagagaagatgacacttctttctaagagtttacagatccttccggagaagttccatggattaacagataccgatacacgttaccgtcagagatatgtagatctgatcatgaatccagagtcaaaagagacatttatcaaacgttctaagatcctcaaagagatccgtaacttcttagatggacgtggatttatggaagtagagactccgatgctggtaagcaacgcaggtggagcagctgcaagaccatttgagacacattacaatgcgctgaatgaagatgtgaaactccgtatttctctggaattgtacctgaagagactgatcgtcggaggacttgagagagtatatgagatcggacgagtattccgtaatgaaggtgtagatacacgtcacaatccggaattcacactgatggaattatatcaggcatatacagactatgagggaatgatggaactgacagagagtatgttccgttacctcgcagaaaaagtgtgcggaagcgcagttatcagctacaacggaacagttatcgatatggcaaaaccattcgaaagaatttctatgatcgatgctgttaagaagtatgcaggtgttgattttgcagaagttaagacagacgaagaagctaaagcattagcagatgagcatcatgtagaatatgaagaacgtcataagaagggtgacatcctgaacctcttctttgatgagttctgtgaagagaagatgattcagccaacatttgtaacagatcatccaatcgagatttcaccactgacaaagaagaatccggaagacccgaattatgtagagcgtttcgagttatatgtatatggacgtgagatgtgtaatgcatactcagagttaaatgacccgattgatcagagagaacgttttgcagcacaggaagaagcatttgcagccggtgatgaagaggcaaaccacaccgatgaagatttcctgaatgcactggaaatcggtatgccgccaacaggtggaatcggatacggaatcgacagactggtaatgctgctgacagatgctcaggctattcgtgatgtgttattattcccgacaatgaagaccttgaatgatgtaaataagaaaaatgatgtaaaatctaaggctgctgaagaagtgaaagcagagcctgaaaagattgatttttctaaggtaaagattgagcctttatttgaggaagcagttgattttgatacattcagcaagtcagatttccgtgcagtaaaggttaaagaatgtgttgcagtaccgaagtcaaagaaactgttacagttcactcttgatgacggaacaggcacagacagaaccattttaagcggtattcacgcttattatgagccggaagaactggttggaaagacacttatcgctatcacaaatcttccaccgagagcgatgatgggtatcgactcctgcggtatgctccttagtgctattcacgaagaagaaggcgaagaaaagctccatcttctgatggtagatgaccacattccggcaggtgcaaagctttattaagatgatgtaaagatgtaccgttttaccaaatagacgggacgtacttcatttgataaaaaactgaaaaaacagcgatttacatcaaacttacatcatttgatgcagaaatcggtgcaagcaagaaaaaatcgcataattagtacgatgagtgggcaattccaatcgggattgcccattttctaaaatgaaaagcaaattcaataattgaaaggagaaggcataatggaatttagagaagatataggacagtatgtttttgagtatgagggactgatttttgcttgggacgaagaaccagaagaagatattcaggatactgtaaaaactttggctaataattattttaagcatttggacggaataattgattttatgctacctgatattaaagaaatatacggacaagttactgttgaagatgtaaagagaaatcttggcagacctattgtcgattatgataatgggaaagtgacttattgcgaacagtcatttgatgattgtcatatatttgagtttgaatttatggacgatgcttttgaaaaattgcagtatttttcaatagatggttagtaaataatataatcaatttgtctatttgccctttgagagaggagaaatccttttctcaaagggctttttctatttatatggatattcgcaaactacaagataaagccaaaacttcatatactctaagcacaaggaggttaaggtttggctatgaataacagtttagcagaagtacacccggagcttgttttggagtggtcggagaagaacttaccacttacgcctgaagatattacctttggttcaaataaaaaagtatggtggaaaggtgcttgcggtcacgaatggcagacaagcgttaaggctcgttctaatggagagaaatgcccgatatgttccggtgcgagagtgattgcaggtattaacgatttggcgacattagagccattactggtaaagcagtggtcgaaaaagaataagataaaaccgacagaggtttctattggttctcataagaaagtgatttggagatgtgaaaaaggacacgagtgggaagctgccattaagagcaggacaataaataaaacgggttgcccgtattgctcccataataaagtgttggaagaatttaatgaccttgcaacacttctgccggatatagcagccgagtggtcggacagaaattatccgttacttccaactcaggttacggtctttgctaatcgtaaggcttggtggaagtgtaaggattgcggcagagagtggaacacccttatttctacccgttccggtggcagcaaatgcccgtattgcagtgggtacatattcctgaaagggtttaacgatttgcagacaacacaccctgaaattgcttcggagtggtcagagaagaacttgtcgttgaaacctgatgaggtaaatgcaaagtcgaggaaaaatgtctggtggaagtgcagaaaatgcggtaacgagtggaaatcagttatcaatgcccgtgtgaaaggtacggtatgccccgtttgtgcggagagagaagttcttgcaggatataatgatttggcgacaacggacagtcaacttctcagtgaatgggattatgaacagaataaattgaaaccgacacaagtatcacgaacttcagcaaagagagcgtggtggaaatgcaggcacggtcattcgtggagtatgaagataaatgaaagaacgatattgaataaaggctgccgaatttgtgagcaagaatatttatcgctatttcctgctttggctgtcagttattattctaataggaaaggcttgaaagcagaacttggttctgaccgattacttggagttccgcttgaaacatacataccttcagaaaagttggctattgagtcaggaagtgctgatgagaatatagaaataatgaaagcgtatatgtgtaagcaacgaggaataaggctgattaagctgccgatgaaaggcactgaactggattatgccgacagcttaaaaagagcttttcagagcgtacatatatttatttcttcggataccgaggaagatgtggagataatcaaaaatacatttgaaagatggagggacagccaatgagagagaaaacctatcatctatacttaaatgaagaagaacgaagccgagtgatacaatcgctcatcgaactgaagaacaatttggcagctcagggacgatacaccgacgcagtagatgatgtcctctgcaaagtgcttgaagcaaagaaaaagaaattgaaaattgaatacatttagaacgttgatttgccgtctgtttcctaaccggagcaggcggctttttttatttcaaaaatttttttgaagaattttttgaaaagcggcgattttgggtgtgcatttcatacccctttgtccaaatgagtgaaggggttcattccggatagcaaaaaacggaagccttttcacttgaaaattgaataagtcattcactaagactttatttctgatgatagccactttagcaggtacgccgtgatttctctttttcagaatagcgagaactccggctatgagtatcaggttgcccctgatatggcgatgacagtcagaatgataatgatacttctctacggagctggcggagtacccggcagaggttagaatcctatgatacagataagcagtctgttccttagtgacttcccgtgagcgttttgcttggcaaggggtgttgagaacaaatattgctatgaccgattaggaaatgagtcggttaggtacatagccataatgcggtggctatgaattttcagaaaggagggcaaaaagaagtgtcgaactgcaaaacgattgccgtatgcaatcagaaaggcggagtcggtaaaaccactacaacggttaatctcggagtcgggcttgcaatgcagggtaagaaagtattgctcatagacgcagacccgcagggcgatttaacaacttgtcttggttggcaggatacagacggtttgggtatcacgcttgcaacgaaactcacagatgtaatcaatgaaacgatgacagaccctatggttggtatcctgcaccacgaagaaggtgttgaccttgttccggcaaaccttgagctttcagcaatggaatttaaccttgtgaacgcaatgagcagagaaactaccctcaagaattatctgagtcaagtgaagaacagatatgattatgtaattatagactgtatgccttcacttggtatggttactctcaatgctttatcggcggcagacagtgttatcattccggttcaggctcagtatttgcctgcaaagggtatgacacagcttgtgcagaccatttcaaaagtaaagaagtatatcaatccggatattaagatagacggtatgctgcttactttggtggatagccgaacaaaccttgcaaagagtacggtggaagcactcagggcaaacttcggtaatcagataagaatgtatcgaacacaaatcccaattgccgtaaaagcggctgaaacttcttccaaaggcaagagcatttatgcttatgagccaaacagcacagtgtctaaggcatacgctgaatttacaaaggaggtgttagccgatggcaggaagaaagagcgacttcactctcacgaaactcgatgatttatttaccacgcaggcacagagagatgaagaacaactttcaaaaatccgagatattccgttagagctgattgatgattttcccgaccacccgtttaaggttagggacgatgaagatatgatgcagcttgtggagagtgtcaaggaaagaggagttattactccggcaacggtaaggcagaaagaggacggcagatacgaacttgtttcaggacacagacgaaagagagcgtgtgaactggcaggatatgaaactctgagaagtgagattgtagacctgaacagagatgaagcaaccattttaatggttgagagtaatttccagaggtcagagatattgccaagtgaaaaagcctttgcctataaaatgcgtttggaagcaatgaaaaggcagggacaaagaaccgatttaactttgtccccagtggggacgaagttgagaacagcagatgaacttgcacaagaatgtggcgacagtagaaatcagatacatcgctatgttcgtctgacaaatcttgttcccgaactgcttgaatttgttgatgaggggcgtatcaaaatgcgtcctgccgtagaactttcctatcttgatgaagattgtcagcgtgatgtggttgatgaaatcgacctgaatgacgcaacaccgtcacacgaccagacaatccgtatgcgaaagctattcaacgagggcaatcttacaacagaagcaatacacgctgttatgtctgaggaaaagccgaaccagagggaaaaaatcgtattgaggggcgacagagtaagacagcttatcccgaaaaacattcccgtcagtcagacggaggattttgtctgcaaggcattggagcattataacaagttcttgcgtaaccgtgcagagcgtgacagcagatagcctgttttacagttcccctttctcacactctaaccccttagttatacttttacctaccgaaaatgatatatactatctcacttgaatataactatctcaaagtatatgtctatctctaaggagtaatcgcacaataggaacggactggaggtgtatggtaaaatgaaaaattaacgaaaaaaccgcatttgtttttcggcaggttattctgctgtaaaaaatcagttaaggcacatcgtagagatacggtgtgtttttcagttttaaggaggaaatttagcaatgattaagtcaaaattcaaaagagtcacttcgcttgtgatggcggcacttatgtgtgtgacaacttttgcaggcattggctcgaccacggcatttgctgcttcgggcgagaaaaccaatgtctatatggttgattttccccgtgatggcgacgctaattacgacggtgtatggggacacaataatctctcatttgtaaatggttggcacagtggaaaagcaccccgcacgaatttgaaggtacttggttcgtatagcggaaatattgcgtattgtattgagccgggagttcctttgaaagatggacagtcgatgacgaagtatgatgagaattacttcaataacatcacatcaaacggtgttatctccggcgatgaaatccgtatgtttatcggacgtattatgcagtatggttatcgtggaggagtttctttgagttggaaatctcagaatgcggacgctgcaaacagcattgcacacgcatacgcaacgcagcttcttatctgggaaacagtcatcggagaacgtgatgcaaacttcaaccacaaatctacaagcggatacagcaatgtaaaagatgtggtaagtaccagccacccactccgcagtaagattttcagctattatgacagtatggtacagagcgttcagaaccatagtttagtaccaagtttctgtaataaatcttccggttcggcaaagacaatagaacttgaatggaacggaagcaaatacacaactactctgacagactctaataatgtgctttccaaatatgattttaaggcaagtatcagtggagtaagtttttcggtagacggtaacaaacttacggtttctatggatactgcaccgagtaaggaatttaccattaccgcaaccaagaaaaatgcagtccgcagaggtgtggttgtatggtcagagggtaaacacaaccaaaattccagtgtgcaagatgttgtcagctatgctcaggaagtaagcgacagtatcaacggttatgtgaagatgaaagtcagctatggttcttgtcagattgtaaaaaccagtgaggacggtaaggttgatggtatcaacttcacgattaccggaaacggtatcaatcagacggttacaacagccaatggcggtaagttccagattgataaccttatgccgggtatctataccgtaaccgagcaggcatacgataagtacgagccgcaggaaacacatagagttaccgttgtagcaggacaggttgcaaaggttactttcaataacaaattgaagcgtggcgaccttcaggtggttaaatcctcagaagataacctcgtagaaggtgtgaagttccatcttttcggtacttctctttccggtgctgccgttgaccagtatgcagttacggataaaaatggtgtggcaactttcaaagatgtgcttatcagtgattctgaaccatatacccttgaagaagtggacacagctatccgttatgtcgtgccgaaaaatcagactgcaccagtgaagtggaaagaagtaaccacaagaaacttcaataacattttgaagaagtttactgtaacagtaacaaagagcgacgctgaaaagggcgaagcacagggcaatgcaaaactttcaggagcagtttacggtatctataagggagaaacgcttgtagataagtatgttactgatgaaaatggtcagttcactaccaaagaatatgtttgtgataccgactggacaatccgtgaaattacaccgagtgaaggctatctccttgataagaccattcacaaggtaggtgcagacccgaaactttatgaggtggaacacaaccttacttccaatgatgtaaccgagcaggtaatcaaaggcaatgtggctatcattaaacataccgatgacggagaaacaaaaattgaaactcctgaaaagggtgcttcctttgagatttatctgaaatctgccggaagctatgacgcagcagataaagacgagagagatactatcgtttgcgatgaaaatggtttcggtcagacaaaagatatgccgtatggtatttataccgtacaccagacttccggttgggaaggtagagagatgatggacgattttgatgtgttcatttcacagaatgcacagacctaccgttatctcatcaataaccgtaactttgaaagctttgtcaatgtagtcaaggtggacgcagaaagcggaaagagtattccgtatgcaggagcaggatttaagatttacgacccgcagggcaatcaggtcaaaatgacctttacttatccgacaccgaccacgattgatgtgttttataccgacgcaaatggttctcttgtaacacctgagaaactggattacggcaagggatattctatcgtagaggtacaagctccatacggatatgtacttgatgatactccggtatattttgatattactgaagaaaattccacagaggaaggtggcgtaactgttgtgaaagtcaataagccgaatatggcacagaaaggtactatcacggttgaaaagaccggagaagtatttagcggtgtcaatgtaagcggttctgaggacagtgatgttatctatcagcctgtttatgaagtggcaggacttgagggtgcagtttatgaagttcgtgctgcggaagatattagcacaccggacggtacactccgctattcaaagggcgaagtggtagatactatcacaacaagttctgatggatttgttaagagcaaagaactttatctcggaaaatacgaggtcaaggaaattaccgcaccttacggtatgattgtgagtgacgaaacacatacggtggaacttacttacgcaggtcagaatatctctgttaccgaaactttcacatcgttctataacgaaagacagaaagttcaggtaagccttgctaaagccattgaaaaagataagacctttggtattggcgacaacggagaaatcaaaaatatcagctttggtctttatgccgcagaagatattgtgtctgcaagcggtacagttattccgactgatggactgattgagattgtcagcgtaaatgaaaatggaactgctgttatgaagtcagaccttccgtttggcaaatactatgtcaaagagattgcagccgatgagcattatgttctttctgatacaaagtatccggttgtatttgaatacgcaggtcaagataccgcaacagttgaaatcaaagtaaatgacggaaaagaaatcaagaatgaacttatctatggttctgtatcaggcaagaagattgacgagaacggagaagcacttgagggtgctgttatcggtattttcagagccgaagaaacagaatttacaaaggatactgcacttatgacaactacctctgcaaaagacggtagtttttcttttgcaaaagttccttatggcaaatggattgtaagagaaatcgagcagccaaagggatttgttcttgatgaaaaagcgtatgaagtcaatatcagcgaagccgagcaggtagttgaaatcgagattgtcaatgagtatgttcacggtaatatcagactcacgaaggtggacgctgaatatccggataacaaacttacgggtgcaacctttgaggtatataaggacatcaatgagaacggaaagattgatgatggcgatgaacttatcggaaatcttgaagaaaccgaaaccggaatttatgagatgaaagagttactttacggaaaatatattgtccgtgaaacaaaagcaccggagggcttcctgcttgataagggagaatactcggttttcattgagaaagacgaaacaacttattctgtcgagaataaggcgggtgttggatttttcaatgaagctatgcgtggaacactgaaaatcgtcaagacatcttcggacggtaaggttaaaggttttgcgttcagagtaaccggagcaaacggctatgatatgacatttgaaacagataagaacggcgaaatcgtgattgagggacttcgtattggcgaatataccgtatcagaagtggcaaacaatgcgtctgccgcatatatcacacctgccgaccagaatgttactatcaaacttgatgaaacagccgttgtaaaaatgcacaatgaattaagggatactccgaaaacaggagatgataccaatatgaaactttggtatgttcttgccggactttctgctgtcggtatcgctgtaacttctgttgttgcacataaaaagaagaaaaaggagggtaacgagtaatggaagcaaagacaattattgctatcgcattagtcgccgttatcgtcggcggctttatctttcttcaggttaaaaaccgtaagaagtaagaaataaccgaacattaaccagtcggggacagagcgtaaaaaactctgtccctttatttttgggaggaacactatgaaacaacagaaaacggtggagagccgagtgcttgaaatcttaaaggaatgcccgatgtcgaggtatgatgatatgcttctcattctgcattattacaaccgatacggatatattcctgccggaaaacttccgcttgaggatattgtctttaattacagggcgtacggacttccttgttttgaaaccatacgcagggcaaggcagagagtacagtccctttttcctgagtattcacgcaatccgcagaaagaagaacagagcggcagtatttctattgtaatcaacattggctaaggaggtattttcgtgaaagacaaagcaacttttcagaataaggtcaaggtactgaataaactctttgactccggttgtgatacggagaaaaagttgcagcagcttgatatggaatcaatcctgaaaatcccgaatatcactattcccgatatgggtgtgattatggagcttcagaagaatacaaagtccggtaagctcttttcgtatttgggcggaggttctgatgaagcagtaaaaagtaacaatgagaagaaagagcctgctatgcaggagcagagataagaaacgataaggaggtgcaagagtaatggcacgaaaatatgaccttatttctgaactttacaaccgcacctgcaaaacggttgtgtcaaatcctcagaactggcaggcattcttagcttcggcttgccgaaattataagttacgctatgacgaacagcttcttgtatatgcacagcgacccgatgcaactgcggttcttgagatagagcagtggaacaaaatttttggcagatgggtcaaccgaggtgctagaggtattgctgtttttgctgatgagaaccgttcacggcaaagactgacacattactttgatatttcagatactcacgaaagcagatattcaagaacagtcccgatttgggatatgcgtcaggaatacgaagctgatgtgattgagacattggaaagcactttcggagagattgagaataagagcagtcttgccgaagcaattattggagcagcaagaaatgcggcagaggataatatccctgattatctgcaagacctttactatgcaaccgagggcagttccttcgaggaagtggaagaggatattgtggctttcatttataaaaatgtcgtggcaaacagtgtggcatatatgatgatgtcaaggcttggcattgatacggacggttattttgaacttgatgatttcagagatgttactaacttcaatacgcaggaaacactcaatgcacttggatttgctaccagtgatattgcagaaatgggattgacggaagtatctaaaacaattactgcactcaaccgtcaaaatcgcataattgtcggtcaggacagaaatgaatacaataaggttgaaaataacgacgaaaggagtttggacaatgaacgaactgacctacacgatggtgggcgattacagccttccgaacctgaaacttccacagcagccggaagtgacgttgggcagatacgctcagatgaggagagagtttctgaaggaacatcacagagtcctttactacaatctcctgacgaggggcgaactgacacatcacttggcggaagtggaacagagagccagcaagatggaggaaacaatcctgagccagatggcacagaaagagggagtgaccgaacagatgaaagcggaggatatgatgaaatgggttcgtctgatgaactcccttcgcagctcggcacaggaaatcgtgaaagcggaagtgatattcgcttagaagatataaaaccgttgccggatatgggcgggcaattatcctttatacaagaacgagcagaggaacaaacagcctctgctttttctattccaaaagaaattatagataattatcttgcgagtggaagcggctttgcgaatggaaagtaccgtatttatgagcaacttcaaaagagtttatcgcttaaagaaaatgccgattttctaaagaaagagtatggcactggtggagggacatacgcaggtggtgtttcggactataattatgattgcgatgcaaaaggtgtccgtatccgaaaaggttatgaggaaaatgcaccagagattcgtatgaattggacggaggttgcaaaggaaattggtcgccttatcagcgatgacagatacctgaataaaaaagaatggtggaactatcctgaatggctcgctgagcaggaagtgaagcgtacaagagtagcagaacaggttaaaaatcgtgaagtgatgtccaccgtaccagccgaaaaagagcctgaagaacaagaaatgccgcaagatgtggagtatgaatatcatcttggcgataaggtgtatatcggtgcttctgagtatgaaattttatctattgatgacgagagagtaatgctctatgactatgatatgccgttgtttaataaggaattttcacacatagagtttgatgaaaaagtgcgtgaaaatccaatgaatgagcatttgattgtaaaagaagtaccaaccgaagaaagaaatgtaactgtcgattataacgatgctttttttatcaatcaggataatgcaactgttacttggatttattataatccggacagtgcagccggaggacagtatgtcacaaatatactgaattttgatgaaatcacagagatagcaaaagacagtcagacatctaatgagttttttgataggcttggaagtatcgccaatcagacacttgccgatgtcggaactgaatggttttcggaagcagaaagccgttttttagaaaagccggattttacagattgcacgcaggatacaatgcagagccttatttcggaagcagaaaaatcttcagtcacagaagttcagaccaatatgggcagtatgccgatagaggattatcgagagatagtagcttcgcagtcaggttttgacagctatgatgaaatgtataagcaggggtatcgcataggaaacggttacgataaagagcctgagccggtagttcccgcttgggagcagaagaaaaaggtcaagggctttgacctgcaccctgatgtgcctatggcagaccgtcatacctttaatctcagagaaaatgaggttgaaacggtaggtaaaaaggaacgcttccgcagaaatattatggcgatacagcttcttaaaaagtgtcaggaagaaaacagatttgccactcctgaagaacaaattatcttatcaaagtatgttggttggggtggactttcagaagcctttgatgaaaataattcagcgtgggcaacggagtatctggaactttcttcggtgttaacaccggaggaatatgcttcggcaagagaaagcacattgactgcgttctacacgccgcccgaagttatcacagccatttataaggcaatggagcagatgggctttaaggaaggaaacttattagagccgtcctgcggtatcggtaatttcattggtatgctgccggacgcaatgcaggacagtaagatttacggtgtggaacttgatacgatttccgcagggattgcacagcagctttaccagaaaacaaccattgcggcacaaggatttgaagaaacaaatctgccggacagcttctttgatggagtggttggaaatgtaccttttggagattttaaggtatcggataaaaggtatgacaagcataagtttctgatacacgattacttttttgccaagtctcttgataagttaagacccggcggtgtgatggctcttgtaacgagcaaaggcacaatggataaggaaaactcggcagtacgaaagtatattgcacagagagcagagcttcttggagcaatccgattgccgaataatacctttaagggtaatgcaggaacggaagtcgtttcggatattcttatcctgcaaaagcgtgacagattgatagatattgagccggattgggttcatcttgataccgatgagaacggaattaagatgaactcttattttgtgcagcacccagaaatgatacttggagaaatgaaaatggtatcagggcgtttcggtatggaagcaacttgtgtgccgtatgaaaatgcagaccttgcagcacagcttgatgaagcggtagcaaacattcacggggaaatcacggaatatgaagccgaggaagaactggaggaggaagataattctattccggcagacccgacagtgagaaacttttcctatacggtggtggacgataaaatctactatcgtgaaaattcccgtatgactccggtggaggtgtcggcaaccgcagagaaccgaattaagggtatgattgccattagaaattctgtcagaacgctgattgaattgcagacagaagattaccctgacagcgaaatcaaagcagagcaggagcgattaaacagactttacgataccttttccggtaagtacggactcattaacagccgtgcaaatacttctgctttttcgcaggacagttcgttctctttgctttccgcattggagataatcggagaggacggagaactggagcgtaaggctgatatgttttccaagagaacaatcaagccgcataccccggttacttctgttgatacggcaagcgaagcattggcggtatctcttggagaaaaagccacgattgatatggactatatgatggagctttccagcaaatcggagaatgaaatctttgaggatttgaagggtgttatcttcttgaatccgctttatgagtatggaaattcttacgaaccgaagtatctgatggctgatgaatacctttcgggtaatgtcagggagaagctgaggattgcaaagaactcggcagaactctatccggaagattataaggtcaatgtggaagcacttcaaaaggtgcagccgaaagacctgactgcaagtgaaatttccgtacgacttggtgcaacttggctgccgccggacgatgtgcaggattttatctttcatttgcttgaaacaccacgctatgcacagtggaatatcaaagttcacttctctccttttacgagtgagtggaacattgagggcaaatcttacgacaaaggaaatgttaaggcatataacacttacggaacttcccgtatcaatgcctataagattatcgaagaaacgctgaacttaaaagatgtgcgtatctttgattatatcgaagatgatgagggaaagaaaaaggctgtcctgaataaaaaggaaacagcgattgctcagtcaaagcaggaaatgattaagcaggaatttcaggactggatatggtctgaccctgaacgaagggaaagactttgcaagttctataatgagaagttcaacagcgtcagaccccgtgagtatgacggaagccatattatttttaatggtatgaatcctgaaattgaactcagggaacatcagaaaaatgcggttgcccatatcctttatggaggaaatacgcttcttgcacacgcagtcggagcaggaaaaacttttgaaatggtagcggcagcacaggagtcaaaaaggcttggactttgtaataagtcactgtttgttgtaccaaatcacttgaccgaacaatgggcggcggagtatctgcaactctatccggcggcgaatatccttgttgcaacaaagaaagattttgaaaccaagaaccgtaaaaagttctgcggcaggattgcaaccggagattatgatgcagtcattatcggtcattcacagtttgagaaaattccgatgtccattgaaagacagagggtaatcttagaacagcagcttgaggaaataaccgaaggaattgcggaactcaagcgaaaccgaggggaaaacttctcagtcaaacagcttgaaaagtcaaaaaaatccattaagcagaaattggataaactcaatgaccagacgaagaaagatgatgttgtaacctttgaggaacttggtgtagacaggctttttgttgacgagagccactactataagaacctttatctctatactaaaatgcgtaatgtgggcggtatcgcacagacggaagcacagaaatcttccgacctctttatgaagtgtcgttaccttgatgagattaccggaggacgaggaacagtgtttgcaacgggtacacctatctctaacagtatggtggaactctacacgatacagcgatatttacagtacaacacgcttgtgaaaaatggtttacagcacttcgacgcttgggcttccactttcggagaaaccattacggcagtggaacttacacccgaaggaacgggatacagagcaaagacaaggttcgcaaaattctataacctgcctgaacttatggcgatgttcaaggagattgcggacattaaaacggcagatatgttgaacctgccagtaccggaagcaaagtaccataacattgcagtaaagccgtcagaaatgcagaaagaaatggttgcttctcttgcagagagagccgagcaggtgcgtggcggcggtgtggacgcaagcgtagataatatgctgaaaatcacgaatgacggaagaaaactggctcttgaccagcgtatgctcaacgatatgctgcctgattttgagggcagtaaaatcaatgcctgcgtcgataacatctatcggatatgggaagaaaacgccgacaagaaatcggcacagcttgtgttctgcgacttgtccactccgaagaatgacggaacattttccgtctataacgacatcaggaagaagctgattgagagaggtattcctgaaagcgaagtgaagttcatacacgaagccgacacggatatgaagaaaaaagaactgttccaaaagacccgtaagggagaggtcagagtgcttcttggctctactcagaagatgggagcaggaacgaatgtgcaggataaacttatcgcacttcacgacgtggattgtccgtggcgaccttcagatttggagcagcgttccggtagaattgtccgtcagggcaatgaaaatccacaggtagatatttaccgctatgtaacagagcagacctttgacgcatacctctatcagcttgtggaaggtaagcagaagttcgcaagtcagattatgacgagcaaatctccggtcaggtcggcagaggatattgatgaaaccgcattgtcctatgcagaaataaaaatgcttgcaacaggcaatccgtatatcaaagaaaagatggacttagacattcaggtacagaagctgaagatgttaaaatccaatttcttatcggagaaatacggactggaggataaggtcatcaagttctacccacaacagattgcttacttgaaatcccgtgtagagggacttacaaaagatgttgaaacagcaaaattacacccgaaaccgatagacgagcagccgcttggaatgatggtatcgggtgtttcttattccgaaaaagccgaagcaggtcaggcaatcatcaatgcctgcaagtcaatgaacagtcccgatgcgataccacttggcgagtaccgtggctttcaaatggaactgtattttgatacggtgcagcgtaattatgttgtgaaattgaaaggcgaaacgagcagagatgtaccgcttggcgatgacgctcacggtaatatcgtgagaatagataatggcattgaacgctttgaagaaacacttgctgatacgaaaaacagtcttgaaaatacagaaaagcagtttgaaacggcgaagcaggaaatcgaaaagccgtttgctaaagaggaagaattgagggcaaaaactgcccgacttgatgagctgaatatcctgctcaatatggataaaaaggaaaatgagattgtcggcggagagcctgatgagggcgaagcagtcggcggcagaaaggagaaatcgtatgagagataaacagaaaggcggtggtcgatatgccttttatcgcacctgagttaatcgttcaggcgaaacagatggacttattaacctacctgaaaaattatgaaccgtatgagctggttaagtattcaggtaacacctattgcaccagaacccacgacagtttgaagatttcaaacgggaaatggatatggtggtcgagaggtatcggtggcaggagtgctttggattatctgattaaggtcaaaggttacagcttccttgaagcggtggaaaccattatcggacacacggcgattcaggctccggtctatgaaaagccacagccaaaagaggaaaataaaccgcttcttctccctgaaaaatgtgcttccaacagagtgattacagagtatcttttcgggagaggaatagattttgaaatcatcaattactgtatctctaatgaccttatctttgagagtctgccgtatcacaatgttgtatttgtaggctatgacgagaagaaagaaccgaaatatgcagcctaccgttccacgaataagcgtaggattatgggcgattgcagtggcagtaaaaaagattattcttttcggcttggtaaggaaaacttggaggaagtacacctctttgagtgtgccattgacttgttatcctatgccacgcttgcgaagctgaacgggcaggattggaaggaaatgagctttgtttcgttgtccggggtgtattctccggcaaagaaaattgaggacagtaaagtgccgattgcactggaaaagtatcttggcagtaatccatctgtcaggaaaatccgtatccattttgacaatgatatagcgggcagaaaggcagcacagaccttaaaaaccattctgccggataattatgaaatcgttgatgaaccaccaaaagcaggtaaggacttcaacgattttctttgtatgcggatgggaatttacaataaaaaaacacacgaaaggaatgaagaacgatgaatgatacaaagattaaagttctcttggtagaaccggaaaagtacccgaaggaaattgtaatcgacgacagtctggaagcaatgcaggaggttgtcggcggggatattgaggaatatatgccctatgacgatgacgttgcaatcatctgtaatgaggaaggaaaggtaagagggcttccgcttaaccgtgcagtttatgtgcaggacaatgataagaaagaaatggtagatattatctgtggcaaattctttatctgttatgcaccgcctgagagtgagagctttcagagcttgccggacgatatgatgaagaagtataaggaacagttcaagtatcctgaacgcttttctaaggaagtgggcggcaatatcgtggctgaaccttttaagccgaaatcaaaggattatgagagatagcagcctgagaacggggcaacccggaggagatgtttattcttagcgagcagaccatttggataaacacagtttcccaaacggtaaaaggctcgttaggggttgcccctaataccccgtgagaaaggagaacttgatttgagagagttattacttatcgccgccggaacactgctcggcagttgtcttggcgttacgatgatgtgcttattccagattaacaaagattgcagaatgcagagaaaggaagatactgattatgagaaagagaaacattcagaagattgttcgctttaaccgcaaggaagcacaggacttggcagcaaaggcaaagaaggcttgtctttccgaagccggacttatccgtttacttatcagaggttacgaaccgaaagagaaacccgatgaccgtttctatgatgtgatgagggaactttcctctatcggtaataacatcaatcagcttgctgccaaagcaaatacactcggtttcattgacgcacctatgctgaagaatgaagctgcgaagtggaataagttccagtcagagattgagaggacgtatcttcgtccaaatcagagcgaaatgaaatggcagtaacaaagttgtggtcggtaacagaaaggctcggtcaggtcattgactatgcgaccaatcccgaaaagacttctgcccaaatcaaaagggagttttcgccggaacagtatcaggctcttgcagatgtcattgcttatgcaaaggacgaagaaaaaacagagcgagaattttatgttgagggtatcaactgtaatgtgttgattgcccgtgaccagttcataacggttaaggaacagtaccaaaagacagacggtatccaagcctatcacggatatttgagcttcaaggaaacagacatatctcctgagatggcacagaaaatcggaatggaatttgcaaatgaagtgtggggcaaaagatttcaggtcgttgtgacaacccacctgaacacaaagcacctgcactgtcattttgtcatcaattctatttcttttgtcgatggcaaacatttgtggggagaggaaaaagcgtggttcaaattccgaaaagttgcagacaggatttgtgagaagtatggactttactatgacccgaatccgaaccgcagtaagcagtcggattatctgacgatgaaagaaaaggcaggtatgccgacacgctactcggttgcaaaagaagcgattgattatgctatcgaccacagcaagaccctgaaagaatttcagtttgcactcaaggaaatgggatatgcctataacctgagtccaagccgaaaatactggacggtcattccaaagggatacgataagccgatacgactgaaaaatctcggagcagattataccaatgaccggattgtagagcgtatcaaagaaaatcgtaacagatgggcagagattgagccgttccagagggcaacttataaaccaagacagtaccgtatgcagaccagagggcagaagctgaaaaagaaaggcggactttatgggctgtatctgtattactgttatagactcggttatctgccaaagtataagaaacagaataacgcaaggcttcattatctcttgaaagatgatttgatgaagctcgataagattactgatgaagtaaggctgctcggacgagaaaatatttccacggacgaacagcttttttcatataagacttccttagaggagcagatgaaaaatctgattgccggaagaacacatctccgaaaaaagataagaacaaatattgatgatggtcagcttcaggcggcaaaagatgaaatcgcttctatcaatggagaattgaaaaaactccgacgggaagtaaaactctgcgaggatattgcggagaggtcaaaggttatggaagaaaaccttgagcatatcgaaacagaggaacaaaaacagcagagaaaggagaaatcacgctatgaacaacggtggtgacgcagcagagcaggtcgttaggctttcgcttgaaggatttgaagttgctgcaagattaagcggttcggcggcgaagaatatcgcattgcttttggtatcggttctgaagcaggagcaaaagacgaagggcaaagcaaggcttaccaatatgattaagtcaggcaaggagctgaaagtcttttccattccgcaaaaggatttgaagaagtttaccgaacaggcaaaacgctatggcgttctttattgtgtcctcagagataagaacacaaagggagagaatgctccggtagatattatcgcaagagcagaggacgcttctaaaattcagcgtatcgttgaaagatttgaacttggcaaggtggataaggcttcgattgtcagtgaagcagagaaagctatcgcagaccgtgaagcggttgagaaagaaaagccgaccaaatccaagagtgaaatcattatggaagaagcggtcagaaatccgatgcagaaagaggagcgagcaaacgcaaacccctcagtcgccaaaacagacaaaagccctctgtcaaggcaaaactcagagccggtagaaacgcaatctgataagggtgttgcaaagccagtggaaaagccatcggtcaaagagaaacttgaccgttacaaggcacaggcaaaacagcaaaaagaagcagagcgtaaagaaccggagattaagaaagacggcaagaagccgcagcagaaaaacggtcagacggtacaccgtcagccgaagaagaaacccaaaacaaaagagaggtaattcactatgacaaatgatttcaaacccgcaaaggctggcggtaatcagccaagattatccaaagaggagtatgcggaaaagaagcgagcagaaaaagaaaaggtctatcagatgattgatgacgctgcccgtgagattgtgagtgaccctgagaagttcaagagctttcttgatacgcagagtcgaatggacagatattccgcagcaaatgctctccttatttatagtcagtatccgcaggcaacacagcttaaagattttgatgattggggtaaggacaatgtgaagattaccaaaggggcaaagagtatttctattcttgaaccagtggaatatacaagagcagatggctctccgggtatttcctacaatgtcaaaaaggtatttgatgttacgcagacaaatggaagaaaagctccggcagtatcagcaaaccgtgacccgaaagcacttatcacgacaatgcttgatgtatctccggtggaggttgcgtcaaccgatgaacttccgtatccgaatatggcagctttctataataatgaaaagcagaccttgtatgtgaagcgtaatgtgggcgacagcgtagcagttgctcagtgtgtcgctcaggaacttggacacgcacagctttccattaacagcgaaagttacagccgcagggatatgggctttcaggcagtgtgtatcggatatatgctttgcaagaagtatggcgtagatacacagaattttgcaattaaccgcattccggagggactggcttccaaagagccgaaagaaatccgtgcggagctttccaagactcgaaatgcaatggcagaaattcacagtcatatctctgatgaaatgttccgcaagaagcaggagcgttcaaaggactatgagagataatggagggcagatatggaaaaagaaaaactctaccacattgctttggacgattacgaacacggtgttgtcattcgctccttaaacgatgagaaaacaaagttgatggaggaaggcaagtccgcagatgcagtagacgacctgcttgtaaaagtcggaaatgccccattgaaaaagttcaaagtaattgaaaggaaacgctcagatgaagcgagataatgacaggcagactgccattattttatctattgtcggtatcgttccggtcatatggctggcacttctgattgcaccttccataagcggaggactgccggagatagcagccaatcttgcgacactctttgataatccattttccataaaattatgtggggacagcctgaaaactgtcctcattttgcttttatgctatggaatgggtatcgggatttatttctcgacaagaaagaattaccgcagacgagaggaacacggttctgctaaatggggcaatgtcagagcaattgataaaaagtaccgacaaaagccgctgtcagaaaataagctgatgactcagaatgtgtgcattggacttaatgccaagaagcacagacgaaatctgaatacgcttgtgtgcggtggctccggtgcaggtaagacaaggttttacgcaaagcctaatattatgaacgctgccagaaacagctatgtgatattagacccgaaaggggaaatcctgcgagatacgggacatcttcttgagaagaaaggttacgaagtgcgtgtgcttgatttgatttcaatggagaaaagccattgttacaatccgtttgtatatttgcagaacgataatgatgtgcagaagctcgtaacaaatcttttcaagagtaccactccaaaaggttcacagagcaatgacccgttttgggatacggcagcgtcaatgcttctgcttgcacttgtattttatctgcattatgaagcaccaccggaagaacagaattttgcaatggtaatggaaatgctcagagccggggcgattgaggacgaggacgacccaagtccttctccgcttgataatctgttttcagatttgatgatagataatcctgaccacattgctttgaagtattaccactcttaccattctggttcttccaaaacattaaaatccatacagataacccttgcagcaaggcttgaaaagtttaacttggagagtcttgctgctcttacttctgccgatgaactggatttgcagtcactcggagagaaaaaggtggcactgtttgcactgataccggataacgactccagtttcaactttttggtatccattctttacacacagctctttcaacagttgttttatgcagccgaccatatccacggcggctgtctgcctatgcccgttcattttatgatggacgaatttgccaatgtttcactgccggacgacttcgacaagatactgtcggttatgcgttcccgtggggtatcggtaagtatcatcttgcagaacttggcacagcttaaagccttgtttgaaaaacagtgggagagcattgtgggtaactgcgatgaatttctttacctcggtggaaatgagcagtcaacccataaatatgtgtcggagctgttgggcaaggaaaccattgataccaacacgttcggaaagagtaccggaagaagcggtaattattccaccaactatcagattagcggcagagagttacttacccctgatgaggtgcgtatgctcgataatcagtacgctattttatttatccgtggggaaagacccattatggatttcaaatatgacattatgaaacacccgaatgtggcacttaccacagacggaaaggcaagtccttataagcacggagaagtcacaaaagatattgcttcgattgctatttgggacattgaccctgcaacacttcctgaaaaggaaatggaagaaacgaactgggaacttctttccgatgaggagatggaagctctgttcataaacaatcaaacaaattaaattttggaggtattcaactatgactatttttaagaaaaaagcaactgacactcaggaaacaaagaaactgcctatgaccggaaagattaggaaaggcttccgtgcttattgcacaatggtcattgtcggtgcgttggcacttggaatgacaacgactgcatttgcagcgaatgacccgcttaccgtagtcaacaatctgtctgactttatcttcggacttatccgtgccatcggtatgattttgcttggctttggtatcgtgcaggtcggtctttcgctcaaatctcacgacccttctcagagagccaatggattcctgactcttgcgggcggtgtcattatcacttttgcgaaagaaatccttactcttatcacaggctaagataagagttacacagttatcgaggggtgtgccaagttaaggtacaccccttaattgtaaggaggtgctttgaatgagtgataactgggtagttcaaaatcttgaaaatgcccttgaaacttggaatgaaaaactgtcggaaatatggacactcatcacaactacaccgcagaactttaagggcgggaatatctggaaggttatcgttgacatcaatggtgcggttcaggctatcgggcttgccttacttgtattgttttttgtgataggtatggtaaagacctgcggaagttttacagatgtgaagaaaccggaacacgctttaaaactctttgtccgttttgcattggcgaaaggtgttatcacatacggaatggagcttatgcttgcactatttaatatcgtgcaagggacaatttcaaccattatgaatgctgccggatttggaactccggaacagacgaccttgcccgcagagatggtaacgaccatagaggactgcggatttttcgagagtattcccttgtgggcggtaacgcttatcggaggattatttatcacggtgctgtcgttcattctgataatgacggtgtacggaagatttttcaagttgtatatgtacacagcacttgcaccgataccgctttccacatttgcaggagaaccgacacagaatgtcggcaagagttttatcaagagctattgtgcagttctgcttgaaggggcagtcattgtacttgcttgtattattttctccgtatttgcttcatcgccgccagtagtgaatcctgacgcagcagcagttacgcaagtgtgggcatatattggggaactggtatttaatatgcttgttcttgtcggtgcagtgaaaatgtctgaccgtattatccgagagatgatgggactttaaggagagattttgagatgaaccaaagagattgtaagaaatgtgtttactatggcggtaaacgaaaaggcaaagtcttttgcctgaatgataaatgcgtgagggggaaagaccgaaaccgcaggaaaggaaacagatatggaagtaaaaattaaccgagaaatcagaaattatacagagtcaatgttttttggactgtcgctcaggcagttcattttttctgttctcgcttgtggcattgcggtaggactgtatttcttgctcagaccgtatgttggcacggaaaccgtatcgtgggtgtgcattttgggtgctgccccgtttgcggcacttggctttgtgaagtacaacggtatgaccgcagagaaagcaatttatgcgtggataaagtcggagtttttaatgccgaagaagttggtatttcactccaccaatgtgtattacgaactgatgaagccaagcattgaacagaagcaaaaggaggtattgaagtcaaatgattaagactcttacgaacctgtttaagcaggataaagaaaaatttgttgtaccgaaaggggtgcaggacgtgattcccgtggcagctatctttgatgatggcattttcaaagtgggaaaggataaatattcaaagacctaccgctttacggatattaactatgcagtggcaagtcgtgaggataaggaagcgatgtttcttgaatattccgaacttctgaactcccttgatagtggtgcaacgacaaaaatcacaatcaataaccgtcggctcaacagactggattttgagcagacaatccttattccgacaaccggagataatctggacgagtatcgagaggaatacaacaaaatgcttcttgataaggcaacgggtgcaaactccattgttcaggataagtatattaccatttccatcaacaaaaagagtgtggaggacgcaagaacttattttgcccgtgtcggtgcagatttgattgctcacttcggcaggcttggaagtaagtgtgtggaactggaaacagacgaaagacttcgtattttccacgacttctatcgtgtgcgagaagaaagttcttttcactttgatattaaggaaacaagaaaaaagggacacgattttaaggattatatctgccccgacacaatggaatttgaaaaggactatttcaagatgggaaaccgttatggaagagtcctttttcttcgtgaatatgcgtcctatatcaaagacagtatggtagcggaacttacggatatgaacagaaatctgatgatgtccattgatattgttcccgttccaactgatgaagcagtaaaggaagcagagaaccgtctgcttggtgtggaaaccaatatcacaaactggcagcgtaggcagaatgccaataacaacttctctgcaactgttccgtatgatatggagcagcagaagaaagaaatgaaagagtttctcgatgaccttacgacccgtgaccagagaatgatgtttgctgttatcacaatggttattacagcagacagtaaagaacagcttgagaatgatacggaagcattgcttaccacagcaagaaaacatctttgccagtttgcaacactgagatttcagcaggtagatggactcaacacggtaatgccgtttggaacaagaaagattgatgcgttcagaacacttacaacagagagcctttcggtatttatcccattcagggtgcaggatattttccacgagaacggtatctattacggtcagaatgttatcagcaaaaatatgattatcgcagaccgtaagcagcttttgaatggtaactcctttattctcggtgtatccggtggcggtaagtcatttgcggcaaagggagaaatcatcaatcaggtgctttcttcagatgcggatattatcatcatcgaccctgaacgagagtattcacagcttgtcaatgcgatgggcggagaagtaatcaatatttctgctacttccgacaatcatatcaatgcaatggatatgaataaggattacggcgacggtgcaaaccctgtcattttgaaatctgagttcattatgtccctttgtgaacagctcatcggcggaacaaatctcggagcaaagcagaagtctatcattgaccgttgcacggcaagcgtgtaccgcagttatcagcagaatgactatcagggacatataccgaccttgcaggatttcagggcagaacttttgcagcaggacgaaccggaagcaaaggaactggcacttgctattgagctttttacgcatggttctctgaacacttttgcaaagcagacgaatgtggataccaataaccgccttatctgctatgacattcttgacttgggtaaacagcttatgccgattggtatgcttgttgtccttgactctatcctgaaccgtatcacacagaaccgtgcaaagggtaagaatacctttatcttcattgatgagatttatcttctgttccagcacgaatattctgcaaacttcctctttaccttgtggaagcgtgtgagaaaatacggtgcatacgcaagtggaattacccagaacgtcgatgaccttttgcagagccacacagcgagaacaatgcttgcaaactcagagtttatcattatgctgaatcaggcttccacagacaggcttgagcttgcaaaacttctgaatatttccgaccttcagatgtcctatatcacgaatgtggaagcaggacacggacttatcaaggtgggaagttctcttgtaccgtttgcaaacaaattccctaagaacacgaaactttataaactgatgacgaccaagccgggcgaagcataaggagggatttataatgtctaaaattcaatttcgcaatgctgcacacagagattttgtattggaaaatctggataagtgtaaagtcaatgactgctatcacagagcatttttctatgtgatgggtatttcagaagaaacgagaatgaacatcggaaagatgtttgatttcaagagggactgtatcataccggaaggtatgcacggcggttggcagacaagtggcacagtcaaggtctgccaccttgcctttaatctctggaatggatttacggaagaaggcagggaaaatctctatacaccggaggaactgttctgttgcggatatgctccgtattttatggagggtatcaagttgaggtatccggagtattgcagagatttgactccacctaagagaaacgatatggaaaggtaagagaaaatgagcagaaaaatctatattattattgcagtggtgtttacggtagtgttgtctgtaagcaccttctttattatccgtaatcacattgactctgccaagcagaatgaagtctatgataaccttgcggagattgtggaggacgagccgccaaaggaaaatgagggcgtgacgttttcggaagataaggactatcttgcggaatatcttgaactctatcggcagaatgaggatatggtgggttggataaaggttgaggataccaatatcaactatccggtcgtgcagtctgtaaatgagccgaacttctacctgaagcacaagtttgataagacctattctgcttatggctgtccatatgtgcaggaaaattgtgatgtgcagaaaccttcagacaacatcattatttacggacaccacatgaatgacggttctatgtttacgggactgatgaagtacagaaataaaagcttttgggaagaacataaggatattacttttgatacactgacggacagacaccagtatgaagtgattgcagtctttaagacggttgtttatacaaacagctccgatagctttaagtattatgagtttacggacgcagaaaatgcgacagagtttgatgcgtatgttgctaagtgcaaggaactttctctgtatgataccggagtatcggcagagtatggcgacaagctgatttctctttctacttgtgaatattcaagaagcaatggcaggcttgttgttgtcgctaagagagtggattaaaccccactctctattatttttcgagaaaggaggaaaccgatggctgatataaaaacaagagatacaagcaaaggtacaatcaagaccataaataaggcagcagttgccacggagcgaatgaagaaagcctatgtgatgacgaaagataaggcagaacattccaccaacgcttcggaaaattccgcagaggaatatgcttccgataaaatcgaagcggcaacggataggactgttcacgaaacggcataccgtgcggataaagtcggcagatggggtgtgcgtgaaacaagacagaattatcagaaagccaaaaggggaattgagaatttcaagaccaagcgtgcagagaagcagcttcaaaaacaatcggtcaatcctgtcggaaaacagagcatccgaactctggagcgtacggagaaaacaattaaacagtctgcaaggtcggcaggaaatacgacagtcaagaccgtatcgaaaggtgcaaccaatactgttcaaaggtcggttaagactgctgaacaaacggcaaagacttctattaagaccacaaaagaagctgccgttatagcacagaaaacagcaaaaacaacagccaaagcaacacagaaagcggctcaggcggcaaagaaagcggcaaaagccacagcagataccgtcaaagccacagcgaaagctactgttgcggcagtcaaagcaattattgcagggacaaaagcacttgtagcagcaatcgccgcaggcggttggatagcagtgttgattattatgattgtcgtgttgtttggtgctgccgtagcaatgttcggaggaggaagtgacagtaattcctatactccggtaagtgcagaggtagaagcctatgaacctatcatacagaagtatgccaaagagtacggcattcctgagtatgtagaacttatcaaggcggttatgatgcaggaaagcggcggcagaggacttgacccaatgcaggcagcagagggcagtttcaatacaaagtatccgcacgaacccaatggaattaaagaccctgaatattctatccagtgtggtgttcaggaattgaaagcggctcttacctcggcagaggtggaaagtccgattgatatggagcatatcaaacttgccttgcaaggctacaacttcggtaatgggtatatttcttgggcaaaaacaaattacggtggatattcctatgccaatgcagtagaattttcgacaatgcaggcttccagacttgggtggagcagttatggagatacgcagtatgtcgctcacgttctgaggtactatccgtatggacgagcctttactgccggaggtaatcaggcgattgttgaggttgccttgacacagctaggcaatcagggcggacaaccttactggagttggtatggctttaacagtcgagtggaatggtgtgcctgcttcgtatcttggtgtgctgaccaatgcggttatattgaaagcggacttgttccgaaatttgcaggttgtgtggacggtgcaaactggtttaagtcaaacggaaaatggcaaaaccgcacttatgaaccaaagacaggagatattatcttcttcgattgggagggcgatggtacaacagaccatgttggtatcgtagagaaatgtgagaatggcacagtttataccgttgagggtaactcaggcgacgcctgcaagcaaagacagtacgcagtcggaagcagcaatatctatggatacggtattccggcatattaaaaattccagacggtgtctggaaaatcgaaaagatggctgctcagttgagtagccatcgggtacattatgagaaatcggttgtttctctgttattcaggaaaatatggtgtgtgtgataagtgaagctgaaaagcatatcggcattttctttactgccgtctaaaaaggaaatatcatcggcaaggataaaaagaattgctaacagcttcttgatatatccagtgtagcaggcataatctacatagatgttagcgatatatccctcggcaaattctatcaggtcagcgtcaatttcaaagctgttggataactcgtaaacggtcttgatgaatttgtccttatcagcaattcgttctttacttggaacacttctgcggttcttctgtatgaatttcaaaaaatcatcagcttccgtaaagtcaggagtgattgtgttgccagttcccaaatctgttttgtaatcctcaaatttctctttttcaaaccgattactgaatattatcttttgttcgtccattcctttttacccctaagtttcttctatggagattgtttgacttggctcttgggttgtgatttgtctttcgccattaacaatcatgaattactacttttgtagtataacataaaaatagttgggaatcatcactaatagttggtttaacttcctttgggtgcgtgtgatttgaaatcgacttaacctatactattagttatggaaacacactaagggaggtgatgtgatgaagctcgatacaatcggcaagaatataagaaagttccgacttgcgaggaaattacgccaagaagatttggcggagaaaacagatttgacaacaaattatattggtatggttgagcgtggagagaaaattccgtcactcgaaactttcataaagatagtaaatgctttaggtgtatcatcggatatggttcttacagatgttctggaaacgggatatacagtcaagaactcaatgctgaatgagaagcttgaaaaacttgttcctgaagatagaaacagaatttatgaagtcatagatacacttgtgaagcagtcaaagcaaatacttccataaaacacagaagttcgtcctaatcgacgagctttctttttttcagtataaaaaatttctgctatcgacaaatttttcgggacttcgacagagagaatatgctataacaacaactgtcagtgatagacacatactaatagacataggaggaagtagaagtgaacgacattttcagacaaatagcaaaagaaaatggaacaaccgaaaaagcagtaaaagaggaaatgcagtttgccattcgggaagcaatgaaaagtgctgaaccggaagcaatagctttttggaaagcagttgcaccggacggaaaagagccgccgatagaaaaggtcatagcaatgattgcattgaatgttaataatagaatgtataattgaggtgcttcggcatctcatttttattattctttagaagagttgcattaggtgtttgcaaaaagtgacaccttagtgtctggaaggttacatttctgcctgaaatcttgaaatgcctgaaaatttaatatataatgttaaatgactaactgtaacgaagaagaattataagatgaagaggtgttactgatgaagatatgctataacaaacttcaaaaacttatgattgacaatcaaatgaaaagacaggatttaatgcgtgcagccgaaattacatcatacgctgcaacgaagataaataagaatgagccggtatctcttgaagtactgatgaggatatgtcaggtgtttcactgcgatatcggagatatatgcgaagttattttagatgaagattaaaacacggaggtaattatagatggcaagggctgctaaaccaaagaaagaaatatcaatggaagaagcactttggaaaagtgctgataaactgagaggttctgttgagcctgcggagtataagcacgttgttctgagtttattcttccttaaatttgccagtgacaagtttgaggaatgccgtaataagattattgctacacacggcgaaaagtatgcggatatgaaaccgttttatactcaggaaaatgtattctatcttcctgaagaaagccgttggaagtacattattgaaaatgcaaagcaggacgatattgccctgaagatagatacagcactttatacgattgaaaagaacaacccggcactgaaaggtgctttgccggataactattactcccgcttacatattgatacggcaaagttggcttctttgcttgatgaaatcaatcgtatcaacactgatgataaagagaacgacattataggtcgtgtatatgagtattttcttagtaagttcgctcttgcagaaggaaaaggtaaaggagagttctacacaccaaagtgtattgtaaacctgattgccgaaatgcttgagccttacgatggaatactttatgacccttgttgcggttcgggcggtatgtttgtgcagtccatcaagttcgtagaagcacatagcggtaataaaaagaaagtgtctatttacggtcaggaatacacaaataccactttcaaactggcaaaaatgaatttggctatccgtggtatttctgcaaatcttggagagatggcagccaatacatttaccaacgaccagcacaaagaccttaaagcagatttcattatggcaaacccacctttcaatcagaagcagtggagagccgaaaatgagcttgtagacgaccctcgttggaacggatatgaagttccgccaacaagcaacgcaaactatggttggatactgaatattgtttccaaactctctcaaaacggtgtggcaggtttcctgcttgccaatggtgcattatctgatgatggtacagagttgaaaatcagacagcagcttatagaaaatcacttggtagaagcgattattattcttccgagaaaccttttctataccactgacatcagcgttaccctttgggtactcaataagaataaaaaggctcgtgttgtggaacagaacggaaagctcaaacgctatcgtgaccgagaagatgaaatactctttatggatttacgacagatgggcagtccttatgagaagaagtacattgaattgacagaggaagatagagctaaagttacaagtgtatatcataactggcagcaggaaggctatgaggaaacttatgagaatgtaccagagttttgttattctgcttcttttgatgaagtaaaggaaaaaggatttactcttgtaccgagcagatatattgagtttgtcaaccgtgatgagaacatcgactttgatacaaaaatgaagtcattgcagggagaactcaaagaacttcttgttcaagaggaaaaatctaaatcagatttgcttgctgtatttaaggagttgggatatgaaatcgaattataatcagttaggacaatatattgaaatggtatccagaacaaactctgatttgaaatatggtattgaagatgttcgaggttgttctaatacaaagcagatgatgcaaacaagggcaaacttaattggacgtacttatgagaaattcattgttttaagaccgcaggagtttgtatttaatagacgtacaactcgcaatggagaaaaaatcggtatggcatataataataccgatagagagtatatttttacgaatgattatgtcgcatttagagttaagcaggaatatcttgataaattgctgccagattatttgtacatgttcttttgtagggacgaatttgatagatatgctcgatataagtcaactggcagtgccacggaattctttaactgggaggatatgtgtgcagtcccatttgaaattccaccaatggattttcaacagcttgttgtaaatgcttataaggttttgaacgaaagaatagaaactaaacagaagataaatgataatttagcggcttaatatgccagctttgccaataaaacagattgcaattcataaagtctttgaatttcgatagtatttgcttcgatttgctcattaaatatatcgaatttatgttgaaagtcctctataacttctgctgggggtacgaggattttcattgactgtatattgtacatcggtaacttagattgaactgcaccaactgttaataattcaatctcttttatttgctttttatagcaaagagtatagtaaagataatcaggggtaaccgtatgaatattagccagtttaacgcagttttcagtaaggtttgcattgttgagcgaagtatgtatttttcctatcaagccaatagttccaacgatagaaataacaatatcgttagtattgacaatataccgtgatatagcagaatgtgtttcttcatcaatatattgaaattgattggtcagacacacataccgattgcttcccaaatcacgcacacggatatatgggtgtgcggttggagtatcaagcagttcgccatcggcagggagtcgtttcccacctttaattgaacaaagactatctaatgtagcaatactgtaaccatctggtagttcattttcattataaaaagctgcaaattgctcctgaaacaatgattgagcagtttcttctaaattatcatttacaatagaactcccatcagtggcgggagttaaaacaagggactgccactggtagtcgttctcttaaaaaataaaaggagaattgactatgaaacagaacctaattacagatgttattcaaggaatgttaccttatttgaataacgcacagacagaaagattgcaagaggtgttgcaacatacactttttgattatgaggtaacaaagacagaaagagataaggaactttcagaacagaatttagtagagtctttcttatcggcaaagcgtattgaaggctgttctgagaaaaccttgaaatactataatgcaacgatacaggcaatgcttgatggcattggaaagggcatcaaatatattgtgaccgacgatattcgttgttatttgacagagtatcaagctaagaaaaaatccagtaaagttacaatagataatataagacgaatactttccagttttttctcttggcttgaggacgaggattatattttgaaaagtccggtaaggcgaatacataaggttaagaccggaacgaacattaaggaaacctattcagatgaagcacttgaattgatgagagataattgcacagaactcagggacttggcaatgattgatatgcttgcttcaacgggtatgcgtgtcggagaaatggtgttacttaatcgtgaggatatagactttaacgaaagagaatgtgtcgttttcggtaaaggggataaggagcgaatagtatattttgatgcaagaacaaaaatacatttgcagaattacttaaacagccgaaaggacgacaatccagcactttttgtttcattacaatctccgtataatcgaatgaatatcggaggtattgaagtgagattacgacagcttggaaaacgattgggactaaataaggtacaccctcataaattcaggcgaacacttgcgacaatggcaatagacaaaggaatgccaatagagcagcttcagcagctcttgggacataaaagaatagatactacattgcaatatgcaatggttaagcagagtaatgtgaaaattgctcatagaaaatacattggttaaggtggtaggaatgaaagaagaatacagatttcttggggaatatatacgacaggtagatattcgcaataaggaaggaaaaaaagaaaatctcttaggtgtttctgtacaaaagcagtttattcagtctattgcaaatactgttgggacagattttacaaaatataaggtagttaaaaaaggacaattcacatatataccagatacctctcgtagaggagataaaatcgctattgcattacttgaagattatgaagaagggcttgtaagcaatgtttatacagtatttgaggtgatagatacagagaaacttttgccggaatatttaatgttgtggtttagccgccctgaatttgatagatatgctcgttttaaatcgcacggcagtgtacgtgaagtaatggattgggaggaaatgtgtaaggtggaacttccagtaccagatattgaaaagcagagaaaaattgtgaaagcctacaagacaataactgatagaatagctttgaaacagaagataaatgataatttagtagcttgtattgatactatattcaatgaacaatttggtaatttcaaagcattagctgaaagttctactgctaatactgattttagttcattgcctgatgggtggactattgaaaatgcagttcattcgtttgatatttctattggaaaaacacctccaagaagtgagccagaatggtttaccagtaatcaaacggataatgtttggatttcaatagcggatatgaaaacaaactccccgtttattttcaaaagtgcagaatatttaaccaatgaagcagtaaaaaagcataatgtaaaaatagttccagctaattcagtattgctaagttttaaaatgacagttggtcgagttgcaatagtgactaatgaagtaactacaaatgaagcgattgctcatttcccttgcacaaaagaaaatcttttctttgtgtattgctatctgaaaaattttaattacggttatttaggcagtacttcttcaataacgacagccataaattctaaaataattaaagaaatgccatttttaatgccaagcaaaaaagaattagatttgtttaaccacaaagtttcaggtttatttgaacaattaaaatacatttcaaaagagcttgatattcttgaagaattatcaaaaatgttactaccgcagttattaggacactgttaagccactaaattatcatttactgcaaggagtgtgaaaaatggaaaaagaaaagttaatcaaacttgcagaggatttatatcaaagtgcatttgacgccaatgcgtattatgcaattatgatgcagtatagagaaatgagcaagaagtataacaatgaaatgaatctttcatctgccttttatcaagtagtgtatggggcgttgcaaaaggcttgttttatggaaattgcaaaattgtatgataaaacaaaagacgttgtttcagttggtttgctcttaaagtattgcagagataatttggacttatttcctgaatacagagatatagtaacaattaaggaagatggcagagaatattctttccaagtgccatatcagcatcgtttgaaaccaacggaagaatgtttctatgaaaatgaagtgaaaagccaaagagaaattctaaaattatttgatacacctgattttgaaaaagtaccaatacaagttaatctgactttttcagaatttttaggattgtatcaaaagcgtttttgctctctcagcaaaaaacaagagaatattcgtgttcaaagaaacaaaatatatgctcataatgacgagaaacatattttagcagaagaaaacgtatgggataaaaatccggttacatatcctgatattcaggagttaatagattttgctcttgattgcaccaggctaatacttggggcattgactggagtaagtcgtgcagtaagttatggaaatatagatgatatggaaggaactctaatgcttgccaaattgggactgaaatatcaggattatgaaatggaacagcgacataagcaaatattgaaagagatatatgctgataaaaaggagtgaacgcaatggcaaattttaatgaacacgcattggaaatgtcgataatggagttgttcaaagacgaggggtacacctatgtcagtggcgaccagatacacagagaaaggacagaggttctgcttacggacgacctgaagcaatacctttataatcgctatgcgaaagacggtatcacaccgagtgaggtggatagtgtcattctaatgctgcgtaatatttccggtacgatttatgaagcaaacaaagctgtatttaagttgctctgcgatggatttattcttaatcgtgaggatagaacgcagaaagacctctatattgaacttattgatttcgacactcccgaaaacaatattttcaaagtggttaatcagtttgaaattgaaggcgtaaataatcagttgcgtattccggatggcattgtgttcgtaaatggtattcctgttgttgttcttgaatttaagagtgcggtacaagagaatacgaccataatggacgcatataagcagcttacaattcgttaccgtagagatattccggagatttttaaatataatgcgtttgttgttatcagtgacggagcaaataataaatatggttctttcttcagcccgtatgatttcttctatgcgtggagaaagataaactcagacgataaagaactggacggtatcaattcccttgtgacaatggtaaaaggacttttccgaaaagaccgtttacttgaagttatcaaagattttatttattttccggataactcagataaggatttgaagatagtgtgccgttatccacagttctttgcggcaaataaattgtatgagaatatcaaggcacatcttcgccctgaaggagatggtaaaggtggtacatacttcggagcaacagggtgcggcaagagttatacaatgcttttccttacccgtatgctgatgaaaagcaaatacttttcctccccgactattcttattattacagacagaacagaccttgacgaccagctttccaagcagtttgtcggttcaaagaaatatatcggagatgaaactgttgtaagcattgaatcccgtgagaaacttcgtgaggagcttcagggacgagagagtggcggtgtttatctgactaccattcagaaatttacagaggatttgcagcttcttacagacagaacgaacgttatttgtatttctgatgaagcacacagaagccaaatcaatctcgaccaaaaggttaagattacagagtcaggtgttcagaaaacctatggctttgccaagtatctgcacgattctttaccaaatgcgacttatgttggatttaccggaactccggttgatggaacaatcgaagtctttggtggtgttgtagacgcatatacaatgacggaagctgttaaggacggtattacagttaatcttgtttacgatggtcgtgcagccaaggttatgctcaatcaggataaggtaagacagattgaagaatattatgctcagtgtgaacttgagggggcaaatgaacatcaagtagaagaaagtcagaaagcagttgccaaaatggaagttattattggcgaccctgatagacttcgtgctgttgcggaggactttatcaaacattatgaaacccgtgtggcagaaggtgcaactgtagcaggcaaagcaatgtttgtatgttccaaccgaaatatagcatacgatttctataaaatagtaaaggaactcagaccggaatggacagaaaagaagatttgtgatgacggggttgttctgagtgaaaaagataaaaaagagttgaagccaatggaaaaaattaagttggttatgactcgtaataaagatgatgaaaaagacctctttgatatgcttggcacaaaagaggataggaaagaatttgaccgtcagttcaaaaatccgaagtcaaactttaagattgccattgttgtagatatgtggctgactggttttgatgtgccggagcttgatacgatttacattgataagcctattcagcagcatacccttattcagacgatttcccgtgtaaatcgtgtatgcgagggcaaagataaaggtttaattgttgactacataggtattaagaaaaatatgaacactgccctcaagaaatatacgaattttgagagcgaagaatttgaaggtgtggagcagtctatcacgattgtaaaagaccagttagaagttcttggtcagatgttccacaactttaacagtagtgatttcttcaacggttctcctactgaacagcttgcctgcctgaatcgtgcagttgagtatgtgcagttgtctgaagaactggaaagaagatttatggcagcagtcaagagaatgaagcaggcatttaatctttgtagttcaagtgagaaattctctgatgaagataaggattatatccatttttattgtgctgtccgttctatccttttcaagttgacaaaaggcgatgcaccggatattgagcagatgaacgctcgtgtccgcaaaatgcttgagggtgcaattcagtctgatggcattgaggaattatttgaaaccggaaagcatatatcggtagacattttcagcgatgagtatatggataagataaatgctattcagttgccgaatacgaaaatcaagatacttcaaagacttctttctcaggcgattgacgagtttaagaaagtcaataagattatgggtgtggaatttgcagacagactcaagaaagttgttgatgagtataataaccgtcgtcgtgatgaagcgtatgccaacgaagtccttgatgatgttgcggagcagcttgcacagttgttgtctgaactgaaaacagaaaagaactccttcaagaatatgggtatagattatgaagaaaaagctttctatgatattttgaaagcagtttccaagaagtttgagtttgaatatccggacgataaaatgattgaactatccaagaggataaagttgattgttgatgataagtcacgctataccgattggtctgcccgtgatgatattaaggcaaacttgcaagtggatttgatattgctgcttgatgagttcggctatccgccagtaaccattgatgatgtttacaaggaagttcttgagcaggcagagaatttcaagaagtatgcacagtaaatgagaggtgtaaatgtaaatatgttttatgacgatttaaatacagaagaacaagtatcataccttattaaaccaatccttcaagtccttcaggaagcaggtggacagttagagcgttctgaaattagagacagaattagtgagttagatgagcatattgctgaatttgaacagaaactatatacatctaataaaacaggaaatcagtacaaaaaatttgattttaagtttaattttgctattaaagagcttagttatgtcggactcatatcttatgtgaaattcaatccaaagattacacttactcaagatggagcaaatgtagatttaacagattttgatgttaagacagaagtaagggataaggctcgaagctattgggaggaacattcgactaagaacaaatcgaaaaacaagccagtagaaacactggaggttgaagacgaggagaatgaatccacagatgacgaattgttagatgatttcaaggtaaaacttcagagtgcaatcgctaatatgtctccagcaaagtttgaacaattttcacgagcacttcttacaaagatgggagtggagtttaccaacaaaggcgttcaggtgtcaaatgatggtggcattgatggttatggatatcacgtagatgccgatgattttagaacaaccagagtggttattcagtgtaaaagatttaattcaaatccagtgagtgagccggatatcaatcaatttcttggggcgatgaacaaatatcaagccgattatggagtatttattactaatagccgatttaccaataaggcaagagaggctgcgagagaaggtacgccgataacactgattgacggaaatgatttaatcagactggttattaaatatgaattgtatataacaccagtcacaacatatgtattggatggtttttataccgaggattgacactaacgatagcataatttactcaaaggatttttaaaagggggcatagaatgatggcaaagcaaaagacctatatcgcaatcgaccttaaatcattctatgcttctgtggagtgtaaagaacgaaatcgtgacccattgacaacaaatcttgtggttgcagataagagcaggacagagaaaaccatctgccttgcggtatctccgtcattaaaaagttatgggatacccggcagaccacgcttgtttgaagtcgtgcaaaaggtaaaagaagctaataatacccgaaggtggaaagcactaaatcgtacatttactggttcgtctgatgacagtacagaattaaatgcgaatccggcattggagattgattatatcgttgcaccacctcgtatggcatactatctggaatatagtaccaagatttacagtgtttacttgaaatacattgctccggaagatattttcccgtactcgattgatgaagtattcatagatgcaaccaattatctgaatacctatcagatgactgcaagggaacttgccatgacgatgatacaggatgttttgaaaacaacaggaattacggcaacagccggaatcggcacgaatatgtacttgtgtaagattgcaatggatatcgtggcaaagcatattgagccggacaaggacggtgtgcgaattgccgaattggatgaaatgtcttaccgcagaaagctatggaatcatagaccgcttacagatttctggagagttggtaaaggctatgcaaagaaactggaagaacatggactttttactatgggagatattgcaaggtgttccatcggaaagtcgaatgaactgtataacgaagaactgctctacaagctgtttggaatcaatgcggaattgctaattgaccatgcttggggatatgaaccttgtacgatggagcaggtcaaagcctataagccggaaaccaatagtgtatgttcaggacaggtacttcactgcccgtatgattacgaaaaggcaaagttgattgtaaaagaaatgaccgaccaaatggtgcttgatttggtggataaaggacttgtaactgaccagcttgtgttgacaatcggctatgatattgagaatttaagtaatccgaacctaaaatatcaatacaaaggcgaggttacgattgaccgatatggacgcaaagttccaaagcacgcacacggaacagcgaatcttgagaaaaagacttcctctactcgattgattaccaacgccgtgatggacttgtatgacaggatagttgacgagcatttgcttgtacgcagaataacaatcacagcgaataaacttgttgatgaaaaatccgtcaagcaggaagatgaataccagcaactcgacctctttaccgattacgaagcacagaggaagaagcaggcggaggaagaagaaaaattagaacgggaaaggcgtatgcaagaagcaatgctgagtatcaaaaagaagtttggcaagaatgctgtgttgaagggaatgaaccttgaagaaggtgcaaccgccaaagaccgaaacgagcaaatcggcggtcataaggcttaaataaactgaaatttgaggaataaaatatgggcatattagaaatagtttttaattcaagaaaatttgatttgaatgatgatgttctgatgggatttgataattactttgataaaaaaagtaaggattataatagtttttgtttagacgaagaagatattaatcctttacaaaactttgtagcacagattaagtctgctgactcagatagtgtaatttatgtatctacttatggctatgaaatcacaaatagtaaaggagaaaaatcaacatacgccgatgctctttggattgacacagttttacctatttcccaaatagagagatatattgaaaaaagtggtgttgctgaaccaagtaatatttcttttgttggagatagtgatgaatgtggaaactataaagtatggattatagctcaggaagagaataatcctcatattatagagctgactgaccgcaagaagatagaccatatgataatattatattgggattgataagttataaaattcaagtttgaaaggagtgttaaatatgaaattcccattttatgatgcaccaaatacagctacaataacctgttgccacatattagagaatggagaatctattttgtatgtatcacatgatgaagatgatggaatgtggcaatttctatgtggaaaagcacatgaaacagacgaagcaaagttagtatccttaaaatcagtattcgacttagataattctgttggtattctaaaggatatgccttgcggttactatgctgaaagaaaagctcaagatgatgaatggagtgttagaaaacggtaactatcagctcggtcaattcaagtttggagaattgagaaaaatcggaagttatggaggtactttatgaacgagagagaaaaaattatccgattatggtttgatatgtggattaagaaagcagatttaggaattgacaatatttttacagatgatgttgtatatactgagagttggagtcctaaatatgaaaaccgcaaaacggtaaagcactggtttgacgaatggaatacacgcggaagtgttcttgtctgggagattaagcaattttttcatcaaggcaatcaaacaatcgtggagtggtattttaaaagcaaaatgaataatggaaatgttgaagaatttgacggaatatctttaattgtatggacacaggataacaaaataaaatcattaaaagagtttggttgcaatcttcataattacaatccatatcgagatagtgatattcccgtatttcgagaagaaaaagcaaattggttttgagaggactataaattccagtttgtcgagcaaaggaggtgctgtaacagatggatgaacattcctatgacgatataatcaatctgccgaatccgacatcgaagaaccatcctcgtatgtcacttcacgacagagcagcacagtttgcaccttttgcggcacttacaggacacgatgcagccattaaagagactgcaaggctaacagatgaacggttagagttaagcgatgaagtcattatgaaattaaatgaccaattaaatatgattagagataatatcggcacagaacaggaaatatcaataacttatttcgtgcctgatgataaaaaatccggaggagcatatctcacgcattccggcatagtgaaaaagattgatgaatttgaacgcaaactgattatgcaggatgaaacagtaattccgactgaacaaatcagcgtgatacagggagaaatgttcaaaggactatatgagtaatagcttggaaagggcaaacaatggaaacaaagccgagaatattatacttaaagaaaatattagaggaacgaacggacgaggaacatccgctttcgacgacgcagctaatcaatatattgaatgatgaatacggaatatctgcacatagaacgacggtcacaaaagatattgctgcacttcaggagtttggaatggatattgttactatccattctactcagagcaaatattttgtagccagccgtaagtttgaattgccggaactgaaactgctgatagatgcagtggagtcatcgaagttcattacaaagaagaaaagcgaaactctgattgagaagatacatacgatgaccagtccggggcaggtggcaaagctgaagcgtaataactatgtggtcaatcgcattaagccggataatgagcagatatattacattattgacgctataaacgacgccatcaatgcaggcaagcagatttcttttcagtattatgattatactggattaaagaaaaaggttctgaagaacaagggcgaagtgtataagctcagtccgtataaacttctctggtgtggggactattattatgttctcggatattctgagaagaaaagtaaggttatcaatttcagagtagaccgtattgcttcaaaacctgagatattggataaggacattattcctatgcctgatgattttgatattgaaaattacacaaaggaagttttctttatgttctcaggcgagaaagttcttgtggatttacggtgtgataacagtctgatgaaaacaatggttgaccgtttcggagaagatgtgacaacccttgcgtatgatatgacgtctttcagggtacagaccgaagtatcagccagccctacctttttcggttgggtgtttggctttaatggaaaagtacagatacttgcaccggaaagtgtgaaagaacagtacaaacagatgattgcacaagccgatgcgggtatgcaggaaaaaggaaacaaagaacaggaaatgtaacactccaaagcatacgatgtcaagaaacggcagaatcttcccataaagctcgaagtatgaatatgcttagggcgtggagtttgaagtttatccgtttgtgaatacaaccgccccaaactatcattgtgaaatttggttagccgtgaacgaaaaaggcgagtaataaggacagcaactgcgagttgcttgtttgagataatgcgtgagactataataaaggtgtaagggaggtactgcataatggatacaaaacaggtcatacttgaacttcgtactcaaaagggaatgtcgcaggatgagcttgcagaaaaagtttttgtaagtcgtcaggcagtttcacgttgggaaaacggagaaacagttccgaatacggaaacattgaaattgctgtcaaaagtattcgatgtttccataaatacacttttaggctcaccgagaaagcttatttgtcaatgctgcggaatgccgcttgaagatgatgatattatcggacacaatcacgatggttctttcaatgaggactattgtaagtggtgttatgccgacggaacatatacttacaatgatatggatgatttgattgaagtttgtgttaagaatatggtaagcgagaatttcacggaggaacaagcccgttcttatatgaaagagctgcttcctactttggattactggaagaaatatgatgagcttagtgataacggtcagtttgaagaattcaagaaaaagttaatcaatgaaattaacgaattgaatgttgacggaatgccaaaggtggaaaaactgaatgcccttgtgggaaagtatgtgaatcttgagtaccggcttccgaatgggcaagcggctaagtttttgaatgaggcaaagacatatctgggcaatcagcttgaatgtgaatacggcggcgatagatgtttcggcgttgttgcagatattgattttattcttatttgcacttatgaagaagacggtaagaatccggaacttgtattgtataagaaaagatgagaatagagaaaaatagtaagccattggagttaatgatttcagtgcaagcaaagaaattttgaggtgttagcaatttgcgacacctcttttcttttgcgaaaaacctacttgaaaaaattttcgtatcaggtataataaaactatcgaaagcaaactgcttccgatagaaaagaaagcgaggtgcaggtatgagaagcaagagtcctgaacttatgagtgagataaaaaagtatatcgaggattattacctgcaaaacagacaatccccatcgactacaaagattgcggaagctgttggcattgccagaggtacagcatataaatacttggtagagatggctgagaagaatatgattgagtacgacgggcaggagattagtaccaatgtgacccgtaagtacagtggcgaacagacacagacaccgattgtaggttctattccttgtggtagtcctcagtatgaggaagaaaatattgaagaatatgtatcacttcctactgctattttcggcaaaggagatttcttcatattaagagcaagcggtcagtctatgattgatgcagggatagatgacggcgaccttgtggttgtcaaaaagcaggtagaagccaacgagggcgatatagtagttgcccttgtggataatcagaatacattgaaacgctacttccgagatgatgagaataagaaaatcattctccatccggaaaataagaagatgaaagacatcattgtagatgagtgctgcattcagggtgtggcttgtcacatcatcaaagaactataacagaggacagacgaatgagaacacttgaaggaattcgctatctaatcaatttggatagtgcggaaatacaacagaactttgccggaggagttgcaccgccggacaaggtggagtcggaggtggacacaacttgagtatttatatgtcaagagccgagttggaagaaatcagcgaaggcttgataacagcttatgctaataagtttagcaatcgagtgattcaatccatcgacatagaacatttcattacagaatttcttatgttacgaattgaatacgcttctttcgcagaagatgatgcaggtaggattggttttctggcagatggagcaacaccactgctggtacatcaggacggaaaaattattccctttgttttcccgaaagataccatcgtacttgacaaatttcttcttgccgaaaaggagcagggacgtcgcaggtttacaatggcacacgaagcgtcacatcatatcttgagcaagatgtatgcaatgccaagtgaaggacgctttcatgcagagtatgacagtgagcgtagttattccaaagaggaactggctcagatgtttgcgtctgttgagtggcaggcagatacaatgggggcttcgcttcttatgccgagaagaattattgaaaatgccttggcgaaatataatcagtcaaatccgataaaagtttatggcgataataccattacttcaaaggataaagctgttatccgcagaatggcagcttatatcggagtatcttatacagccttggttattagattgagagatatgggactatttgagtatcacaatatccttgagtacatttccaatgagttaaatctaggaggtgtttcacaatgaggttacagactcaggtagaacctgaaacacaaaagagattgcttctgtcaagagtagaagcagaaagtctgaaagagcgtgatattctctgcccgacttgcgggttcaggatacaaagagttttttcagacgcaaccggacatttgagtgtgaagtgtcagaaatgcaagaatgtccacattttaaatcttgcttacttccgaagaatccgtaggaacggatatggcaggaattgcaggcgatgaagattacaagtaaatatcgaaacgatttctaatcgagtaagcggagataagcaatttatttgctaaactaccaagcaccgtacgaagccggataagtgaagaatagaagtattctttgctgtccagattcgacggtgctttttttgttgctgttttattcgattatgcttcgtgcagtattaggtcttttcccttacttgggaaaggacttttatgttttataacgcatggcagtgccagatagctgagtacccgtaatctccgaattttgaaacttatcaatttttcaaaattcaaaggagattacggaaatgacaaacaaacttacattaacagaacaagaagaattatttgcaaaggattgtaaactgataaatcttaaatacgaatataacggttataccggagatgaaaaatgggcgattattacggaattgtctgtaaaagagctttgggagaagtatccccttgttatagaaagatattctccgtttgttcatctttccattgcacagggagaggtaattgacgatgcaaaccgaaatgaggacaagtatgcaaagagaagcagtcgcacacttgactgctatggatatgacgatgaaatgtcctcacagttccataaagaacttgccattatgtttgacgacccgtttgaaagagcagaggaagaaaggcttgaactggaaagagaagaattgcgtcagtgtgaaatcaggaaagcaaggatagcactttcaatgttgcagccatttcaaagggaacgccttatgaagaatgtgtgctgcggtctgagttccagagcgattgcaaagcaggagggagtatattacagctccgtagataagtctattgctgcggcaaagaaaaattttatcaaattttatgaaaatctctgattttgggtgtgcatttcagacccctttgtccaaatgagtgaaggggttatttcattccggatacgaatgacactttaaaaatttgattcttgtgaggttatgtatatgaaagaaaaaatgatttgtcgtggggatttattctactatgactttggagataacagtggttcagtacaaagcggagagcgtccggtgcttgtcgttcaggcagacgattataaccagaatgctccaacgattattgttgcagcggttacaagtgtaatcaagaaaagatatttgccatcgcacattattctcggcgaggagtttggactgaagaaaccgtcaatggttcttctggagcagattcggacagtcaatagagaggatttgcgtgaatacataggtacggtagatgacgataaacttttcagacagataaatgcaactttgaaaaagacttttggactttgggtttacaagccggaggggaaagaaaatattcgctgcctatgcccgaagtgcctgaatgattacattcacaatccggactatattgtaaggcgactcgacccatttgcaaagcgaaaagacagatgtgataagtgtgatggggatggttgggattatgttgttaccgatagatattcatcaaagaaagaaaagaggtgcaagaatgtctaatagcagtgtaaagaagctgagttataatgtacctctttggcataagcctaatttgtcgattgaagaagcatctatatattccaatattggaacaggaaaactttatgaaatgacggaaaagcaagattgcccatttgtactttggataggaagccgccgaatgataaagcgaaaaatttttgaggaatatattgcaaatcagtattctatttaatgaaaaagtcaaatttgcgatgagcaaattcgcatcgttggctcagtgtagatttttgagtatgctgtaaccacgcaaaggaggttacagcatatgaacaacgaaaaagatgaaacaatctataatgtcccactttgggagaaagtaatgcttacaattgatgaagccgcagcttatacaggtgttggaagcagaaaaatcagacagcttaccgataatgaaagatgtccgttcgttttatggaatggctcgaagcgacttatcaagagagaagaatttgttgaatttataaaaaagcagtattcgatatgaggaggtattattgtgagtaatccagtaaaaaaagaaagattagaagtaccgatatggcataagccgtatctgaccattgatgaagctactgcctatactggcattggcagagaaaaacttcgtgaaatgacaaggtttgctgactgtccatttgtgttatgggtgggaaaacgccgaatgataaaaagagaattgtttgatgagtacattgaaaaaatgtatgagatttaggaggtggaacgatgaatgtggattttgcagatgaagaaatgattgcttatcgggaaagccttatagaaaagaaaaaagagcagccattttggaaaaagaaatgtttgtcggtaaatgaaacagccgcttatacaggtatcggaaggggaaaaatacgagagctgatgaaaaagaaagactgcaattttatgacgacagacggttatcaggtgtatgtcatcatcgacaaacttgtggaatttttaaatagcaggaatgaaatataggaggaacagccgtggcaagaccaaaacgaaaagataaaacaaggacagttcttcgcacgggagaacttcaaagaagtgatggaagttatcagtacagttggactgatgaaaaccataaaagaagatatgtctattcaaaaacgcttgaagcactcaggattaaagaggaagcgattgagaaagacaaaagtgatggcataaaagcggaagcacgatatgttacactcgatgatttatatgagttgtggaaagacctgaagagaggattgaaaaataacacttttgagaattacaaatatatttatgaaacctttgtacgtcggcaaatcggttctaagagagtttcaacatttttgaaatcagatattaagagattttataattatctggttgatgagcgaggattgaagccagcaacggttgatggtgtccacaacattcttcatcagatatttgatatggcggttgatgataactatatcagaaacaatccgacaaataatgttttgagggaattgaaaaaagctcattgcttcaagacagagaaacgcaggggacttactagacctgagcaggaattgtttatggattatctgaagaactctaatacagcagtgtattggtatccggtgtttgcagtaatgcttggaacggggttaagagttggagaagttactggactcagatggtgtgatattgatttggaagatgggattatagatgttaatcacacgttggtttattatgaccacagaacttctgaaggaaaaaagggctgctatttcaatgtgaatactccaaagacagaagcaggaaatagacaagttccgatgctcgattttgttaaagaagcatttgttatggaaaaagaaagacaagaactgctaggggttcactgcgaagcgaccatagatggatatacagattttatatttctcaatcgcttcggacagccacaacatcaatcgactttgaataaggcaatccgacgcattatccgtgattgcaatgacgagcagtttttggaaaacgaaaatccggaagtgcttctcccacatttcagttgtcattcgctcaggcatacatttacaacgagaatgtgtgaagcgggggtaaatataaaagttattcaggatacactcggacataaggatataacaacgactttgaatatttacactgatgtaacgaaggaactgagaaaatccgaatttgcaggtcttgactcttatttccaaactgagtacaagaaagtagcaaatggttagcggaaaaatcaataagcagaaagagagctaaaacatcaatttgtttggctctctttttgcgttatggtgtataatagaaacataaaaactatggaggggatattggtatgttgagtatatatttaggggatatggaagaagccatttaccacccgccaacatattttgataacacttatgaagatgaatggataacagaaccgttatccgtagagatgatacaagatgtagataaatcaaaagtaatcggagagcatattattgaaagtccgtttttgggtgctataccaccgacacaattatctggtggtgttaaaaccttaatgctgttggcattcgatgaaagcggaaaagtatttaatgctgcttgtggagataattgtgctaaatggatattgaagatagcagaggaaaaagacctgacaatcaatcttcggcacattatggattttggcgacgaaccttttgaagcgaagatattaaataccggagaaaacgtacataatatgttggaatttattcgtgttgcagcagactatgtataaccaaaagtaattgagatatgaatttaggtatattgactcttagcctaaatttggataaaataagacatagctcaaatttgaatagcgagttttataatagctaatttacatcaaatacatcaaatacatcaaataatacatctacttatgcggaaagcaataaattttaaaggtaaacaagactttttatctggttgaaaacagcaaagtagagggtcgctcagggatatgggcggtttcagaactgcggtggagaaagtcccgacaatgaagtcactggatgctgataagaagactgctaaggctgaaactaaagcggtagaaactgcaccagagaaagaagaagttattgatttctctaaagtaaaggttgagcctttgtttgaagaatttgttgattttgatacatttagtaagtcagattttagagcggttaaggttaaagaatgtattgcagtacctaaatcaaagaagctgttacagttcactcttgatgatggaacaggcacagatcgtacgattttaagcggtattcacgcattttatgagccagaagaactagttggaaagacacttattgcaatcacaaatcttccaccgagagcaatgatgggaattgaatcttgcggtatgctgttgtcagcaatccatgaggaagagggagaagaaaaacttcatcttttgatggtggataatcatattccagcgggcgcaaaattatattaatctctctatatagcgagcagaaaaaacgtgtactgcaacaaatttgtaagttgatatgaagagacatgaagttgaaaagtagataaattttgaatatcgtaaaataacataaaaaggaactttcttttggagaaatctaagagggagttcctttttttgttgcaatatggttggagcgaaggagatttataatatgcaagcactttatggatatcatgaatggaagctatgcccaaacacatttcccttgcaagttatgggatgcaggagaaaagggacttacattatctgcttttgaatgggagaaggatagaaaaacgctgatatatgggcaggtagactatatgtatggagaagcactttataagcctgaaatgaaagaaggaaatcctataaggttatatagtttggatgaaatcacggagatattctgtaaattaggacttcgtatttgtaacagctttgctgatttcagtggaaagccgagttctgataatgatattcaattgatggtttattccatacgggaataaatcttcatcaaatctttatttttttctgttaggttatatttcagtaagaaatgaaatatagaaggaaggatagtaaagatggaaatgatgttacagacacaaaatctatgtaaatattttagaaaacagaaagcggtaaataatgtttcacttaatatcgaaaagggacagatttatggactgcttggaccgaatggcgctggtaaatctaccacattgaaaatgctgaccggtatgatgaaaccaactgcaggaaagatttactttgatggaaaacttttggataggaaagatttatcaaaaataggagcgttaattgaaaatccgcctatttatgaaaatctttccgccagagagaatttgaaggtaagacaattattgcttggtacagatgaaaacagaattgatgaggtcttgcagattgtatcacttacaaacaccggaaagaagaaagcaggacagttttctttggggatgaagcaaagactaggcattgcaatggcattgcttggagaaccggaacttttgatattggatgaacctacgaatggattagatccaataggcatcgaggaattacgagagctgatccggtcttttccggaacagggaatcgctgtaattctctccagtcatattctctcagaggtacagttacttgcagataaagtcgggattatttcaggtggaatcttaggatacgaaggagcattaaagcagggagataatcttgaagatttgtttatgaatgtggtaagaaaaaaccagaaagcaggtgaaatccatggttaatattataaaagcagaacatcaaaaagccaaaagaaccatgcgaaaaaagtttatctggggatttcctcttcttacatttgtcatggcatttatatttactcttgggatgacaaatgcttatgcagaaagtgtttggaactggtggtatacacttttgctgccggggatgattgctctattttgttatctttctgtggcgcaggagaaaaagataaaatactatcatttaatgactattcccacagacagaagaaaattgttgctggggaaaattatttatattgggtacatgattttgttttctaatgtgattgtgtttgcaggagcaacgcttggaggctttcttctaacgacacatgttccagttggaggagcgttgattgcagtattgtttctgacggtttctgagttatgggagattccggtagctttatttttaagtgaacgatttggaatgattgtaaacctgttcgtctgcctatttattaccgtcagcggtgtggtaatatcacaaaccagaatctggtatgtacttgtttctgcaatccctatgcgaatgatgtgcccgttgcttcatgttttaccaaatggacttgccgcagaagcagggaatcctcttttggatacgggagtcattgttccgggaatgtgtctctcaatcatctggtttgtttttgtaacggttctgtttttgaaatggtttgagagaagagaggtgaaataagatgattggaagatctcttaatgcagacttgcgaaagatgaaaggaacatctgtgattctggcacacttactgattccgattataaccagcgttatatttttaatatattactttttttcaccatggaatgaaaatatgaaagtgattgcattttatcaggcaataggagcaggacttccggtacttattggaatttttacagcaagtgtgatggaacaggaacaaaatgcaggtgattttcaaaatctgttgtctttaccggataaacctgcagcatttttatcgaaactgttgatgctactggttttgtgtctgtgctctatcctattgacagcaatcatattcggaattggatttggaagaatcgcatcaagcgatatcgaaatcatgaaaagatgtatatttgcagcattgctgctgtggggaagcagtgttccactttatctgtggcagctgattctggcttttcagtttggaaaaggggtatccattggagcagggattatatcaggactaattagtgcattgatgcttaccggacttggagattatgtgtggaaatatgtatttgtctgctggacgggtagagtaccatatacttatctgcaatctgtattgggagaaactagtgtaggtgaatggttgtcattcataccaggttgcttaatatttacagggattagtatggtatactatttttggtgggtaaaccactgggaaggaaacagaatatcggaatagaatcgagggaaactatggcaaaaatattggcagttgatgatgaaccggcaattttggaaatgatagaaagcattttgaataaggatggacatctggttaccaaagtaagtaatccactaaaaattaatatggaagaattacatcgttatgacctgattttactggacattatgatgcctggaattgatggcttcgaattatgcaaaagaattaggatacttgtggattgtccgattttgtttcttacggcaaaaacggaggaaaacagtctggtaaacggactttctttaggagcagatgattatatttcaaagccatttggagtgatggaacttcgggcaaggatcaatgcacatcttagaagagagcacagggaacattctgtccggatggttttggggagggtctgtattcaaatatctcaaaagaaactattggttgatgataaggaacttcctcttacgaaagcggagtacgaaatctgtgaatttctggctaaaaacagaggacaggttttctcgaaggaacagatattggaagcggtctttggctttgacaatgagagtaatgacagtactataatcacgcatatcaaaaatataagagcaaaatttgcggattatgattatacaccgataaaaacagtctgggggattggatataaatgggaagagtaaagagaagcaatgcactcagcaggatttttatgagatatgtactggtcatgcttggatcattagttggtttggtgattgttgcttatctgctgctgtaccttttgattagtgtgggctgtatttatccggcaaattatgcagagcaaaagattaatgaagcatatgatacgattctacgtgcagataaagtgactgctgagatgattcctgcactttgtgattatgtaatcttttcagagaatggagagaaaataggtggagatctgtcagaacaatacgaacagatagcatggaatgttgcaaagtacggaaacgcatccgggaaatatttttataaagtaattgtaagggaaaatgaatatgttgtattgcaatatcgcctgacacctcaatatcattcagcttttttgagggagcattttataggaccacagaatgtgatgagtattatgtcagtgattggagcggtagcgattatcatcattccgtccatacgttttggaaaaagaatcaaaaagcagatgcagcctgtattagacgcaatcagacaaataaaggatcaaaatctggaatatgagacatcctgttccggtatcaaagagtttgatgactgtttatcggcaatcgatgatatgcgagatgcattgcgagaatctttagaaaagcagtggaaaacagagcaggaaaagaaacaacagatgtctgctttggcgcatgatattaaaacacctcttacgattgtacggggaaatgcagaactactttcagagactgaactgaccacagaacagaagaataatatcacttatgttttgaacggcacaacacagatacaaagttatgtaaaacagttgatagatgtcacaaaatcatggaattgcagtgatgttacctatacaacggtgaggttagaagattttttcgcagatataaaggaacaggcactcggactggtagaaatctatcaccagaaaatagattggaaggcgggacaaagtgataaaaaggtaacgattgcttatgatccaatgttccgggccgtaatgaatatgattcagaatgcagtggagcatacaaaagaaaatggaatcatttatattgacgcaaaggagcaggatggccggctgacattcattgtggaggatagcggatcaggatttacaaaagaagcattattgcatggcacagagcagttttttatggatgacacaagtagaaatggcgaagcccattatgggatgggactattttttgcaaaaactgtggctgaaaaatatggtggaggtattaaactttcaaattctgaaaatacaggtggggcgagggtagaaatatttttcctgagtagtcaagaaacaagctaaatagaccgcaattaagctatgtaaaagaaattttacatgcttttatctaatatgtaaaagccttttgatagacattactactacgtttgctgtaatctcatggaagaaggaggcatacagaattatgatagctgataaaattaaaaatgctcgtactattctttattacataactatcattatagttgggattatatgcacatataagaagagaataatataacttttgttatgatatcaaatgattttttcatttaatataacattgcattggatgaaaaaatgtgtttggagatgaaaacataatcgaattgaaggttgacgattcaaacataaaaagagctgggtggcatctacccagctcaatcttctacatgcattaaatgcagatgttttgatctgcggtagaagcttttatcaatgaaacacttgagtataatccggatggattgattatttttctttctctgcttgtcgaaagtgatggatagaatgtataatattgttaatgatccagagatatttattttggaaacagcttaatcaatttggaggtataaaatgaaagcacataagcattggtcaatcggagcgttaattactatgattggaactttctatactggatataaaggatccaaatcaggtcataggtattttgcgtgtagcactcttatatgtatgatcatgtctatgtatacgggacataaaatgatttcaggtaataaaagaacaagaaaacaggtggaaaatacaaaagcggaggaatagtaaatgttagagttaggaataaaagcaccggattttgaattgccggatcagaacggagaagtgcataaattaagtgattatttaggtaaaaaaataattttatatttttatccaaaggataatacaccaggatgtacgaagcaggcatgtggcttttctgagcgttatccacagtttactgagaagggagctgttattctcggagtaagcaaggactctgtagcgtctcacaagagatttgaagaaaaatacggactggcatttacgctattagcagatccggagcgtaaagttattgaagcatatgatgtctggaaagaaaagaaaaattatggaaaagtatctatgggtgtagtaagaactacatatcttattgatgagcagggaatcattataaaggcaaatgataaagtcaaggcggcagatgatcctgaaaatatgcttaaggaattggcataatgaagattattttatcacctgcaaaaaagatgattgtagataccgataacttagcaccggttgagctgcctgtctatattgataagacagcagaagtattaaactggatgaaaagcaaatcaaaagaagaactgaaagctatatggaaatgtaatgacaagattgcagagcagaactttaacagattggaaaatatggatctttataacaggcttactccggctgttttagcatatgaagggattgcatttcaatatatggcaccatctgtgtttgaaattcagcagtttgagtatttgcaaaatcatttaagaatcttgtctgcgttttatggcattttaaaaccaatggatggtgtgactccttatcgtcttgaaatgcaggcaaaggttggaattggagatgcaaaaaatctgtatgagtactggggagaattgttataccgctcagtaatcgatgacagtaggattatcattaatcttgcatcaaaagaatactcaaaatgtatagaaaagtatctgacaccacaggacagatatattacgattgtattttgtgagttatccggagataaattgataacaaaaggtacatatgccaagatggctcgtggtgaaatggtcagattcatagcggaaaataatattgaaaatccggtggagattcagaaatttgacagactcggatattcgtttaggtctgatttatcttcagattcagaatatgtatttgaacgcaaaataaatttgctggaaagaattcataacactcatggaattgaatttgtggattatgatatttcatttaaaggcatttgcccgaaatgcagggagaaggtaaaggaggaacagcatggataggaaagcaatgtataagttgagttatggactgtttatattgaccgctaaagaagcagaaaaagataacggatgcatcattaatacagccattcaggcagcttcggaaccaaatcagttaagtatctgtgcaaataaggcaaattatacgcatgatatgattcaaagaaccggaaaatttactgtatcagtcttaagtcagaaggcacaatttgaattgttcaaacattttggcttccaatcaggaagagataccaataagtttgaaggatttgagcagtgtgccaggggcacaaatggtatttattatattacagaaggtacaaatgcatacatttccgtgacagttactaaaacagaggacttgggttcacatacgatgtttatcggtgagataaccgatatggaagttttaagcaatgttccttcagtaacatatgattattatcagaataatattaagcctaagccacaggaggttggaaaaacagaggacagtcagacaatatggcgttgcagaatttgcggatatgaatatgtaggcgaggaattaccagatgactttatatgtcctttgtgcaagcacccggcatcagattttgaaaaagtagtaaagaaaacggaggtaaaagagatggcagcaaacaaatatgcaggaacacagacagagaagaatttacaggaggcatttgcaggggaatcacaggcaagaaataagtatacctattttgcttctgtagcgaaaaaggaaggttacgagcagatgtcagcattgtttttaaagactgcagataatgagaaagaacatgcaaagatgtggttcaaggaattagcaggaattggtgatacaaaagaaaacttagctgctgctgcagaaggagagaactacgagtggacagatatgtatgatggctttgctaaaacagcagaggaagaaggtttccctgagcttgcagcaaaatttagagcagtaggagaaattgaaaagcaccatgaggagagatatcgtgcacttcttaagaatattgaaactgctcaggtgtttgagaagagcgaagtgaaggtatgggaatgccgtaactgtggacatattgtagtcggaacaaaggctccagaggtatgcccggtatgcaatcatccgcagagttattttgaagtacgtgcagagaattattaagggagaatatattgaatggattacattaaataccaatcagggcgtttatagaaaacagttaaatccaggacaggagccggttgcagatttctgtctttgtgacggagagcaggtggaggaagtatatgcatactgcaatttacatggattatggaaatgttaaaataaactttgtacatacgaatactatagagtaaacgtaatattgaacaaaaaagaaatgcacagttcttagcttatcgtgaactgtgcatttttgtaaataaatacttttaattagccgattacggcatcctctgctgtaaaatgttccagagaattttcttttacctgaatgcagatataagtaattccagaaatatcggatgcaaaaaactgacgctttgcagcaggtgcgatttttagccagtctccagttgaaaggctaatttcttctccatcaattatgactttgccgttacctgaaagaattccatagatttcttcattttctttatgagaatgaacaaatggtacatttgctcctgcaggtagttcgtttaaactgatttctgcaccagttaaagacaacttttcatgcagctcaattcggctttccttttcaatagttgtttttgtgtaatttgccataataatacctccatagttaatttgtagtttctggttgcttggtattagtatagtgtgagacacatacaaaaacaagtacgcacctttttgtaactgtacactcaaaaatgaatgtgttacaatagactcggaggtgagaattatgcgagcaaaagaagaattaccggaatgcccagttgcaacagcagtatctctcatcggaggaaaatggaaactactgattttgcgtaacttgaaagagcgtccatggagattcaatgagctacaacgaaatatagatggtatttcacaaaaggttttgacagatagtttaagacaaatgatgagtgatggactggcatatcgccacgattaccatgagcagccaccgagagttgaatacggcttaacggaactcggaacaaaaatgcttccaattgttaactcacttgctgactttggtaactactataaatcaattattgaacagaattaaggacgttagtatttgaaaagctcgaacaattccagtttggagaattgaaaaaaacggaatttacctattaagacatataaactcttgacaataaagctcctatatagtatgtttttaataaactactatataggagcttttgtatggaaatgaatggaggatttcttgtcaccaaaataaaacagcttggagaccggattttcgagaagattctcagtgaaaagaatattgatgcgtttaatggagcccagggacgtattctttatgtgctgtggcaggaggatggtatctcaatcaggtcactctcgactaaatgcggattagcgataacatctcttactacgatgctggaaagaatggaaaatcaagggctgataagccgtgttcagtctgaaacggacaaaaggaaaacactcctgtttctgactgagaaagcatatgccttaaagggcgagtacgattctgtatctgatgagatgggcagtatttactacaaaggtttttcagaggaagaaattacccggtttgaggaatgcctcgaccgaatcagaaagaatcttgaggagtggcagaagtcatgagtatttatatcaaagatcagattcagaacatgaatatcgtcattggctgcacagaggggtgtacatattgctatgcccgcaacaacgtgaaacgctggcatatgattgatgacttcgctgaccctgaattctttccgggtaagctcaagatgatggaaaagaaacgtccgcagaactttcttcttaccgggatgagcgatctctccggatggaagccggaatggagagacgaggtatttgcaaagatccgtgaaaatccacagcatcagttcctgttccttaccaagcgacctgatttgctggattttgatatcgatctggaaaacgcatggtttggcgttacggtgacgagaaaagcagaactgtggcgtatcgacgcccttcggaaaaatgtcagagcaaaacattaccatgttacctttgagccgttattcgacgatcccggcacagttgacctttccggaatcaattggatcgttgtcggcaccatgaccggagctcagagcaggaagattcatacggagccagaatgggcatggtctctgacggatcaggcacataagcttggcattccggtgtttatgaaggaagaccttgtccctatcataggggatgaaaatatgattcaggaaataccggaagaatttaataaagtgttagaggtacagaaatcatggaagaagtaataaatggaatcctcattcgtgaggtggaaacaaagaacatcatgactaagtctagtctgccggtaggcggttactcggtcaatccctatgtgggctgtacacatgcctgcaagtattgctatgcttcttttatgaagcgttttaccgggcacaaggaggaatggggcactttccttgatgtgaagcattggccggaaattaaaaatctgaagaaatatgccggacagcgggtggtcatcggttctgtgacagatggctacaatccacaggaggagcaattcgggaataccagaaaacttctggagcagctgatcggcagtgacgcagatattctgatctgcacaaagtcggatcttgtggtacgggatattgatctgttgaagaagcttggacgtgtaaccgtttcatggtcgatcaacacactagatgaaaatttcaagaacgatatggattctgcttcgagcattgagcaccgtatcgctgctatgaagcaggtatatgaggcaggtatccgtacagtctgtttcgtatccccggtattccccggtatcacggattttgaagcaatctttgagcgggtaaaggatcagtgcgatctgttctggctcgaaaatctcaatcttcgaggcggtttcaaaaagacaattatggattatatcgccggaaaatatcctgatcttgtaccactttacgacgagatctataacaagcataaccgcagctactttgaagcacttgaagtaaaagctgagaaaatggctaagaagtatgattgtgcctttgtggataatgaaatgccttatggcagagtcccgcaggggcatccggtgatcgtagattatttctatcatgaggaaatccgtgggacagagaataccggaaaaagaaatcgctaatttcaagtttgccgaaatgtctttctaactttccctattttacaggctttccagtccattcattagtgaaatgatatgtattttcccttatttttgcccttatgagataatcgtaagggaaataagggaaagtttcatttagtcgttgcctgccactttatcaagtaactttgcggattcccgcttggcttttcttgtagagtgtgcatagacattcatggtggtactgacatctgagtgtcctaacagttcctgtacatctttcggagctgctccatttgccagaaggttgcttgtgtaggtgtgtcgcaactggtgaaaatgaaatccttcaaatccatccagtttctgagcaatcttcctgcaaacaattcctaacgtgcttggcagttccaaacttccatccggtcttaagcagacaaaggatatttccttataatcttctggaacattctctgttccgtccagatgatagaactcatagtaaactctgtttttgtcttttacttctctgtagtagtttttgtggtaaagttctccgtactgcattcggtttttaagttgttcctttcgggcattgcgaagaatctctgccagtgtatctccaaaatcaacaatccttaccttttttcgtttggttggtccgatgatattcttgtgccttgaaccatcatatcggatactgcgtctgatcgtaaggcactgttcttcaagatttacatcctgccatgccagaccacaggcttcaccgatacgaagtcctgcataataagctatctggattggaagtattgccggtggattgtaatcctgtagaaattcaatcagtctttcataatcctctcgtgggattggctgtatatcgccatccatgtcatcatcagaaaacaggtcaacctcatccgtctggtatttcagcttaatatactgcatcggattgaaagtaatatattgctttggtgatactgcaaaccggaatgactgctgtaatactgccgagaaagaacgaatgtaatctttgctataaccttttctttctgaaccatctggataagtgccaccaaaggaaagcagatcgaagaaggcttgtaaatgctcagatgttacatttttcaactttctctctgaaattggatgcttcttgatgttggtaatggcaccgaggtaattctggactgtcccattactgagcgtaccggtctttaattcttcctctgcccatatatcaagtaattctccaattgtaatattttccgactttgcaatgaatttcttgctttcgtaatcgtccattgcctgacggagcagtttttccgtttcacttttactttctgttccagcgtattctttctgaaccagattgccgcttgcatcttctacatagaagcggtagtaccatttctttcctttttttcttacagatccttttgccataatcgtgtgtctcctttcgatatcagacaatcggaactgatgaaatgcttcttgcgtgtaagtatatcataactccggttgtcgttctataccgaatcggaatcctcatacaaaacttctgataaaagattttcaagcctttgttctgccatttccggtttcttggaataaagccttacgatatctgccatgtcgttaaaggcattaacagtgtgggtgatctcccggagaaacataatctcgttatattcatcattcgattcaaaccccattacttttgcaatatcagcttcattcgtgttgcccttgtaattcttgcaggcaaactggaatgattccagaaacaggttatattgctttaacatcaacagcagtaaatctttggaaaaagcatcttcctttttactaaggtcgagaggtaactgtttgagaatatcgcccattgcatcacgaatctgtaattctttcttatccgtaatatcggtttcgtattcatcggtttcccctctgagccattcaatagatacatgaagtgcttccgaaagaccttccagcaccatctttttggtattgtcaatcgaaccattctcataacgcaggattgtggaagctgtaactcccatcttctctgcaacataaggctgtgtcagatttaattccagacgacgctgttttgccctgctgcctatcagcttgcgtagttctttatctttcatgctgattgcctcctttttcggtatgtatgaattatagcatgtacctcacataattgcaatatgcaatataataattatttttaaaatttcataacgcttgacaacacaatataaaaccgctatactaacagcacaacagaaattgcataatgcaatttgtaaggaggtgacaagatgacggaaagaaagattgcattatccatcgaggaagcagccgactatacaggaattggcagaaacactttgagaaagctggttgaatggaagaagcttccggtattaaaggtcggaagaaaagtccttattaaaactgacattctggaaaagttcatggaagccaacgaggggcgtgatctgagggataaaggaaatgtaaaagctgtcacaagaaatgtggcaacttaaaaaggcggcttcctaagaaaccgccaaaggttctatcagaccgaagccatgatatacctacacgcaagaggattataccatgtgcttctcctgatatgcaaccgggaactgttgtttatcggaaaaagaaaggatgaagacgatatggcgaaatcaacaaagacttatgaagaaagaatacgtgcattagagaaaaaggaacaggaaagcattgaagctacaaaaaagctcattgcacagcggaaggaactggaaaagcgaaagaaagcagaggaaagtaaaaaacgaacccacaggctctgtcagattggtggcgcagtggaatcggttcttggctgtccgattgaggaggaagatttaccaaagttgataggcttcttaaaaaggcaggaaacaaacggaaagtttttctcaaaggcgatgcagaaagagccacttacagatatggaggaagtgtaatggcggagggagtggtttttccattcccttcattgcctttgaatgaagggcgcacttatggacaaccagaggtcgtccttataagtttgccacaagtggcaaccggtctgcgcttacgcttgccgggctcgttccgtcggcggggctttcagccagacctgctcatgccgcagggggcactcttgcgcagagggcgttccgacagcttcacttctgccaaaccagaagaagatgctgtcggaaatcaatgccggatacggcagaaagggggaatcgtatcatggcgatatttcactttacagtaaagattgtcgggcgcagtaaaggaaaatctgtcatatccgcatcggcatatcttaatggagatgtgatgaagaatgaggaaacaggcagaatcagttactatactttcaaaaaggaagtcgtctacaccagtttgatgatgtgcgaaaatgcacctcctgaatggctgcatgtaccggaagaaaatataaaaaggtttcaacagtctatccgttataaaagagcggatgataaagatgccgcattggaaaagtttaaaatcacatttcagaaacagcggctatggaatgaggtattgaagatagaaaaaaatgcagatgcacagcttggacgctcatttgaattttccttaccgaaagaatggagcagacaggaacagattgattatacaaccgaatatattcaaaaaactttcgtagataagggaatgtgtgccgactggagcatacacgataagaatgatggaaacccgcatgtgcatttacttgtaaccatgcgaccattcaatctggatcattcatggggcaacaaagaagtcaaggattgggattttgtcagagatactgacggaaatattgtagttgatgaatcccacccggactggtggcaggataagaaaaatcctgaccggcatggaatccgcattccggtacttgatgaaaacggagtacagaaagtcggagcaagaaaccgaaaacaatggaaacgggttctgaccgatgctaccggctggaataatccaaagaattgtgagttatggcgaagcgaatgggcaaggatgtgtaatcgacatttatccatagacaatcagattgaccaccgctcttatgaaagacagggcaaattaaaagtccctacgattcatgagggtgcggatgcaagaaagattgaggaaaaatatctcaccggacagataaggaaaggttcatggaaggtagaggaaaaccagatgattaaaaaacaaaatgcactgctgcaaaaggtaattgcaagctttggtaaggtatccggtgcattgtcagtatggaaggagtggttgaatgacattagaagaaagcaaagaaataattcccatgatggaagcaatgattacacagatagaggaacagcagaatatcatggcagagatgcttcaggaaatacaggaaaaggacgagaagctgatgtgctttcaggagcaggaagaacgattgcagcaattagagaaagaattgtcagagctgctacaaatcttaccagatacagaagaattgttgatgcttctggaagaaaagacagaccagatacagaaactcacagacgaaaatcagcaatggcaggaattggcacagaaattaaacagcgagaaccggctattgcagaaacagaacagcgaattactgaacttgaacagcaattagagaaaggaaggttgattgatgaacgaattaagaaactcaaagagcgacgatcaactggaagagttacttctgctgacagagcagatgcaggaagaactcgaccagaaagaccggactatccgggaactgaaagtgcagctcgacgaatcgctgaccttgaacgagaggttaaacagcgagaacagagcagggaacattcaagccttaaagaacgacttgaggaaaacaaaagaattgttgcagagcgagaaagagaaaacgcttaccgcaatggacatgatagaggaatgtcgagataagctaaggcaggcagaacaggaacgggattatgcactctcccatcagaaaaaaatagagataccggttgaaaagtcggtgctctatcaaaagtgcaggaattgtaaccacacagcttatctgaaagcgaaggaaaggtatgatacgcagagagaaaaaatggcaggcagatataaagcaaaaacagctatgtatgaagcattgatgtttctgctgatatggtattccgcatcaactactctttttcagatgatacagtcaaaggtatttgtttctgattgcggaatattctttgatgcaatcggaactttcacacagactattgctggctggattgcactgataggaaagaatgtggcacagattagtaatggaatatccaatcctgtcattgccggaattatatactggctgataagaatattgatttgcggtggatgtctggtgggtgcgggaatatttttggcattcatcggaataaagattgtaggtctatataagaaatactgttgggacatgattaccataatggtaatacttataagcatggcaacagctatctactttgggaattggataaagacagcattgccaatcaatctgctatttctcttattattcgtgcaactggtatatgttggaatcaggtggtatgtaaagggatggcgggaagcaagaggatattattaaaaatccgattgtaaacacacaattttatgtgcttaatcacatctctttgcattttaataaaatcctacaaaatccttgaaaacaaaggattcattgtaatgtgttcgctttatccctttatatgatttcacactatgttccccttgccctgactgttcataatggtaaaagcaagggctggaaaaacgcataacgcaatacaacaaagtgtagcaattgggatattatgaacgaagaaatcatcttttcataagcagtcaataaggctgaaggaattaatctctgccgccttattgactttcaggtgggcttcaattataattaaatcagctgatttaaaacaagcgatttagtaaaaggagagataaagtatgccaccaaaagccaaatttacaaaagcagaaattattgaagccgcattaaatattgtcagggcagacggatatgaggctttgacttcaagagcgttaggaacatatctcggtagttcggcaagacccatttttactgtatttaaaaatatggaggaggttcagcaggatatgattaaatctgctaaagctctgtataaagaatatgtcaataaaggactaacaacagagcacccgtttaaaggggtgggtacacaatatattctcttcgctgttaatgagcctaagctttttcaactcctctttatgacggagcaaaaacaaattcctgacttatctggtgtacttccgctgatagatgaaagttatgagcaaattctattgtcaattcaagatgattacaaaatttgcaaggcagctgggaaaaaactgtatcatcatctttggatatatacacacggaattgcaacgctttgtgccacaaaaatgtgccgatttacagacgaagaaatcagtacaatgattactgaggtatgtatgagtattttgaaaaagctgaaggaaggagaaaataatgattaaagcgagaaatataataaaatcctaccaaaacggagaaagccgattccaagtattaaaggacatcagtcttgatattgaggataatgattttgtggttattctcggcgcatctggttctggcaagtcaacctttttgaatgtaatttcaggtcttgaacgccctgacagcggtaaagtgttttatgacggaaaggatattacagcactttctgataatgaattaacttcatttcgtaaggaaaatgtcggatttatttttcagcagtattatttgctacccaatatgagcgttgataaaaatgtaaaaatgggtgctgatttagcaaataataaagattataaaaacgtcattagagcggttggactcggagaaaaactacataaatatcccagcgaactttcgggtggcgaacagcaaagagtatctattgcaagagctttggcaaaaagaccgagagtattatttcttgacgaaccgacaggagcattagacgaacaaacaggacgacaggttcttgattatatatgtaaacttcaaaaggaatatggttttacgattgtaatggtaacgcacaatttgaatattgcggaaatggcaaacacagttataaaaatgaatagcggaaaaatatctgaaatttacacaaatgaagcacaaaagactgcttatgagatagggtggtgatggtatgctcgttggaataaaaaatgtttcaaaactcatcggtatttccattatagcctgttgtgctgttcttgtttgtacaatgtttctgaacttttattttgatattcgattaattgagagtgaaattacatctgaattatcaatgtttttttataatgctcaggtttctaccgcaaaagtcgtttgccttgtaagtggcggatgcttgcttttaactgcgattgttatgttgttgttttatattaagcattatattgacacgcataagaaggaacttgggatattaaaggcgttgggatattcaaatatcaaaattgcaaaaagcttttgggtattcggaattagtatatttattggaactgtaaccggatatgcaggagcatttcttataatgccgtggttttacgctctacaaaatgaagataaaatgcttcctgagataactatcaattttcatccaagcattttattttattttgtggtattgccgactgtgtgtttttcggcactttcagtttattatgcctggtacaaattcaaaaaacctgtgttgctgcttttgaaagataatatgcaaactgcttctaaaacaccaaatcatagaatcgaaaaaagcagtgaattgtcgtttgtagagtatttgaaaaggaataccttgaaatctaaaaaggcacttgtattcttcattatttttgcttcgttttgcttttcagctatgacacaaatgtcgtttagtatgaaagatttatcaagtgaaatgatgggtgtgatgatgttggtcatcggacttgtattagcgtttacaactctgtttcttgctataactacagtaataaacggaaatacaaaaactattgctatgatgagagtattcggctattcacagaaagaatgttgcagggcaattttaggaggatacagaccgctgtcctatattggttttataatcggaacagtatatcagtatggattgcttcggcttatggtggatattgtatttaaggatgtcgagggtgtacctacgtataaatttgactttcctactatgcttatttctcttgcttgttttatcacgatttatgaaattatgatgtatatatattctgaaaaaattaagaagatttctatcaaggaaattatgattgagtaacaggggaaaatacatacaaacaatatggatacagtgccctgtctggtgaaaaaaactgaacaatgatactggaaaataccaaatttaaaagtttcatctgcattgtcagaagtgaaaaaatatagaataatagggacaaataaatctaaaagggttatttgtcccttatttatctttgaattaaatttctaaggaatcttccgcatctacccacatttgcatcgttccatcaagatacaatcttgcatattcaagtggttcatcaatagcaagtgcatttaatgcacaatctgatccaggtgttgtttttaaattcttttctgcttcccagcagtcaatgcggagcatatagccagcactggtatatacatcaatgctgtttctgtgtggattgtattctgcaaatatcgttctcatcgtatcaaatctccttatcgttcaatcaatcatttgttaaaaaaatagaagcatttcaatcagttcaccatgtcgttttaattttgtgttatactgttttataggattttcttgcccttgtatttgcccttatcagagttcgtaaacactggtgggacaatataatacaagggaaacaataagggaaagctcacctgcgataaacttagtgttttcaagggcttgagagatatttgataataaaatataacaattattaaattccttggaatacatgaaatctcaattccagtttgtagaattcaaaaatttaatatgaaatgtgagatagagcgtatggaaataatctatacgttctattttttcgccttttttgaaaaagtgattaaaaaactattgacattttgttactggcaaaactgcaaaatcgattttgatttcctgtggtgccagattttcaccatttgatattcaggagcttcgagaaagcatgtcgtatgacgaaatggaactggatatgatcggcgatcagagaacagccatgtttgtcatcatcagtgataccgatgacacattcaattttaaaggtttttaactttcctgattttaaaataataccgatcaataatatcctgcaatgtaatggatttcattttttcatctaccatattttgaatttcatgatagaagtccccaatagcgaattgaatgttgataccgattccacaatccggattggtatctgtgtccaggtgaagcagcggcttatcgccctctacagctcggtagatgtcatacatattgattttatctgccgattttgcaagagcggcattcgcatgaccttgtgtgttgacaacaatgcctgcatttttcagggttgccataagttgtctgacataagccgggtttgtcttgatactttctgcaatttttgtgctggagagttgttcgtcatctccaagagcaataaatataagaatatgaatggtgtcactaagctttgtggaatatttcatttgtcacctcgaattttcttcttgcaatttttaaacttacatgataacatgactttaatgcttgatgtaaatttaattttaacaagtaaaaaaataaaagtcaagcaaaataaaaggtgtggaatctgatataaaaaaggagataaagtggtgtatgcaaaaggaggaacaagtcagttttctggcagaaaaaatccgtcaggcagatgccgttttgataggcggtggttctggtctttccagtgcggcgggatataaccattatcattggctgccctaaaatggagtacagtttatagtagtgtatagcgtgtaccaagttataattatggggttgaaaataacagtatacacagataatgtggaaaaatgtgtatgacgtttatatagaaaataacattgaaaaagaaattcaagaatgggtaaattcattaaatttaaaatagaataataattacatgagtgacagaagataagaatctgaattccctgtcacttttatattatttgataagaaaaaagaactggtttatatccgataagaatatagactggttcttatttttaatatgctattatatacacagggagtcggggaatgtcgaactatagcaagccggaaaagaaagcattgatatcggtatgaaagagttttgcaagtgcaactaattcagatgccttaatgttcatgcgatttgtttccagtttggcataggtacttttggtgatggagatacccataagatttaattttgcaactacttggtcttgagtcatattgtttttatatcgaattgcttggatatttttaccaatatccatatctggtctaatcttttgcataatgatgaactccccttataaaataaaaagtttcgtaatacagaaacatatatattgattctaaagaatttaaattttataatgtttcgtaataaggaattatttttaacaggaagaggtaaaagtataatggatgtggagatggaaaagagaaaatttttaaatctatgtggcaaaagagatcgagcattattgtcagatgaaaaaagaatgacattgggggatatggaacgattgacatatctgacagaattttttgaactggagaactatggaatcgccttatggaaagaatttggtgatgatgtaaaagagccatttgaagcgatgatgaaaatgttagatgagccggagtgcatagaagatcgatggcttgatgacgaagcaaaaggggaaaagtggttgttagaatttcaggaactggcattaacggaagaatacagggaatggattcgaaattatatcgataaaaaatatgaagaaagaggattaccatatccgacaggagcagacttcgattaagaggtctgcttttttctggtcttttgggaggtgataagaggtggaagtaagtatttatgaactcttggcggcagcaagagaatcggctaaatctgattatataaaaggggacagcattttgtgtgagaagagatttcatccagatacccattacatggtagaaatagaactgctgaaaaatgataacaagctgggaaaaaagggcaattatatacggaagtttttgacagaaccggagtatcttcccattttacaaaagcaggaaaaacatctcataaaaataaaaagacaggcaattgttcaaaaaggaaacttgcgatatatccctcccccggacaggctggaccgccgccgggagagggatcttttataaccggctgggaaggaacagtagtgttcctctggcgatagtggtataaaaaagccagattttccgcaggttttgggacgctggaacatagaaaagtgttcacgaatggcacttttgcaacgatccgttgcagcagtgacaacatttttgaccttacgttaaacagaaaaaatgaaaggatgtgattgcgataatcataggaattgatcatggctattatgccattaaaacaagacaagtgtctttcccaagtggaattattgggtatgattacgagccgtataccatgcagaatgttctgcaatatcaaggaaagtattatgtctgcggtacgggaagacagacgctggtaaaaaataaaacgtccaatgataattattatctgctgacgttggcagccattgcagaagaaatcaagcatcggaaagcggaacgaaagacagaggtaattctggctgttggacttccgctttcaagttttggaagagagaaacagggattcagggagtatctgttgcggaaagagcagccagtgcgatttttatatgaaagtgagttatatgagataacaataaaagatgtgaaactgttcccacagggatactctgcgcttgctctgcatccagagtatctgaagaatgaaccgtctgttctgcttgttgatattggtggctggaccgttgaccttatgaggctggacaatgctgttccgaatgcagcaacgtgcagaagtctggaacttggagtaatccgatgtattgatgagacagcagaacaagtgcgtagaaataccggactgtctgtgacagaaactcaaattgagcgtgtgcttcggagggaatcttgcagtatggcagaggaggccagacggatcatacaggaaaacggacggaaatatatagaaagaatactgtctgcggtgacagaatccgggtttgatctccgggcagtacccaccgtatttatggggggaggctccgcaattttaaaacgccacgtgaccgcacaggacgcgatttgccgccccgtttttatagaggacgtccatgccaacgcaacagggtatgaacggattgtagagcagatgtggacgagatgacacgcccggtatattcgttccgcccgaacctgaaaaatccagaacaccagagggcatgggagaaatttcaaagtgttccagaagggcagaaaagccagtatctggttcaggcaattctggaaaaagaggatcggaaatggatggaagaagtcattcaaaagacgataaaagaaagtgttcgggaattaggaatatgtggcactacggaacaattgaaaacgaaaccatcatcggaagaaataccagatcagatgatggattttctatctcaaatggaaaatttgtaaagggggtgaggcctatgattgcacgatacatacattgttggatctgctaggggtaaggcaagaaatgcatcgatatctttggtgggtattgtgaatagctttccatgcggctttggagtatgttgtgtgtagcaaaagtgaaaggagaaaggttatggcagagatgaaaaatatctgcggaaagatcccgatggacttacatgagaaagtaagagaagagattgaactcacagaaagcagcacacaaaaatttttacaacaggtcattgaagaacatttcaacagagtggaaggaaaaggagaaataagcatgggagcagtaagaacagtagcagtacaggtatcagaggaattattccagagattaaaagtagtcatcggaaagaaacacatgaaacagaaagacttcttaattcagattatagaagaagcactggaaaaggtagaggtcgaatggcaaagcaaagagcagcctgaagaatccgaacagacaactggagaattgggaacagaagaaactcaaccggaagaaagaactgagccggaaagggaaagtgaaccagaagaggaagccgaaccggatggagaaagtgaaccgaaagaggaaaacaaaccagaaggggaaagtgaaccggaagaggaaactgaaccagaaggagagactgatccggaagaatccaaagcagaagaaccaacagaatggtaaccaattgatacagaataacgaagggcggtatgagagatcatgccgcctgtttttatcagcaaaaaggaggttgatagccgcaaccattcaattttttgatctctttagcggaatcgggggatttcgtgaaggcttaagacgggcaggaaactttgtctgtgtcggacattgcgaggtggatacttatgcggataagaactaccgattgctgtttgatacggaaggggagtggtattgtaatgacgcaagaacaatcgaaccagaacgaatgccagattttgatttactctgtgcaggatttccttgccaggcattctctatcgccggaaagcgagaaggatttgcagatgcaagaggaactctcttttttgaaattgcccggattcttgaagctaaaagaccctcgtattttatccttgaaaatgttcccggtttgttatcgcatgacaaaggccggacgttttgcaccatcctcagtacgctttctgaactggggtaccatgtcgaatggaaagtgcttaacagcaaggatttcggagtcccccaagcaagaaaacgggtgtatattgtcggatattttgatttccgatgtgccggaaaagtattacctgaaccagaaacaaatggagcagctcttgttcaagtccgggcaggaagtcaggggaaaagagtctacagtcccaaaggactaagctgtaccctgacatcacaggcaggtggaatgggcggcaagacaggattatatgatgtaggtgttccaatcaaagagaatacaaagctcggctacaaacttgcaagagaaggggacagcatcgatctgggttatgcgaatctcaacagcaggagaggaagagtcggacaccagatcgcacataccctgacaacaggtgttcaacagggaacgctgcactttgtcgatctttcacctccgccggtggtaacggaagaatgcagaagcctgaataccagacaatgcggtgtccacaaatacaaaggagaatgttctggtgtattagcagaggatggagcaagagcagtcttaacaccagcaaaagagaatgttcgtcagaacggcagacgtatgaaagaacccgaagaaccgatgtttacaattactgcaaccgatcgtcatggcatcttgtatcacggcagaataagaaggttagttccgagggaatgtctgcgactgcagggttattacgactggcagattgataagatcatagacagcacttctgacgcacagctttataaacaggctggaaacggagtaactgtcaatgttatcgaggcaattggcagattgttacaaaaggcagactccgaacttaacacacagaaagtgtctgagaaaggaatccattaggcatgatcggaataaaagaccaatactttggcacagaaatcgaaatgacagggattaccagacaacgtgctgcagaagttgttgctgaaatgtttggaacagaagcatattatgacggcactacttatggagtctggtcagtgatagatctggaaggaaaaaagtggaaatttatgtctgatgggagcatttatacacaacggaaagtatacggtcgaattgtagacgcaggtggagaatattcaacagaaatggtatcaccgaaattatcctatgatgaaatgggaaagttacaggaagtagtacgatgtctgcgacagcatggaggttttgtaaatgagtcctgtggtcagcatgttcatgtagatgcatcgaatcatacaccgcagagtctgaaaaatgcactgacaattatgtatgcaaaggaagatatcctgttcaaagcactgaaagtgcaggagagaagagcaaatagttattgtcagagggtgcgaccggaggtattggagaaaatccgaaaaataccaaataaatcaatcacaatggaccgagtaagaaatgtctggtatggaggcagggatggaagtcatacccattatgatcatacccgttattatgctctgaatcttcatgctgtgttttccaagggaactttggaatggcgttgttttgaaagcacactacatgcaggaaaggtgagagcaaatattacactggcattagccatttccgcacaggcaatcaatcagagatcgacacagatgaaaaagacactgatatcagaaaacccggcatttacatttcgtacatttttattgagacttgggttaattggagacgaatataaaaatgttcgaaaacatctgctggcaaatctggatggtgatcttgcgtggagatatgataaaagcacgtatgagtgtctgaagaaaaatcaaaggacagaaggagtcagatagaggtgagaaaaaatgaaagatagatattacttcgcttatggcagcaacatgaatctggagcagatgaagtacaggtgtccggctgcggaagttgtggaaaacgtccggcttgaaaattatcggctggcatttcggggaagggctccgggcaatggggtagcaacggttctgccggaaaaaggaagctatgtcgaaggagtcttatggaaaatcacagaagcgtgtgagaagagtctggatttttatgaaggattcccaagtttttatgggaaagaatcgattcgggtaaaaaatcaggatggtgtggagaaagaagtgtttgtatatatgatgaacgctccgcacaaagatgttccggcaaagccatcgaaattttatctggatggaattctggaaggatgtaaggataaccagattccaacggagtctgtcatggaagcggtaaaacgtaccagacaggaagtaaaaaaagaaaaaaatcgatatgcaagataaaacgtaccgcagaggaaacatcttctgcggtattttactgaaaaaatctatttataataggaaggaaaagcacatgaaggttagaaaattaaagaccagaattgctgcttttggactggctgtcctgatgggcatcagtaccttgagcagtgcgaatgcgtttgcggccgaacagacaggctcggaacagcagacggaagtacaggcatctgaacaggcggtaacaagccagaaagatacatcagttacagcagatgatatcacaaaagcagtttcagatgatacatttgcagtggaaaccagtatggaaggaatccattatgatgcagaaaaagaagatgttacgcttgtaagtatcaaagatgagaatggtggagagtatcattcagacaaagcaggaacatatattgccacttatatggtcgttccaaaagataagagtgacagctataccatcacccgtaaagtgactctgacggataccgaaggacaggcacattccgaagaaaatggtggagagaaacagaagtcagatacagaatctgaagatgattcggattcgcctgtgcagaactacacagatgtagaaattgaaacatccgaagaagatgcatctgcacaggcaatcaaagaactgaaagaggacatcgaagagggaaatgtgatggtattgtctgcggctgaaagagctacaagcagcggttccacagttacattgacaaaggggagaactatttattatccaagttatattggaaattatcttacttgcctgtttacagtcaatggaaaaattgcatactgccttcagtcccagaaagcatccccaccgagtggaagttatgtagcacaggtactggacagcaataaaaatctgcagaaagtcctttattatggttatggcggggcaggagatctgacaggaagttatctgtctggaaaaacggaagatgaaaagtatgtgtatacacacattgcagccagctatgcttatgcaggagaagccggatttacagggtgtaattataatgaccttgtaaatgcaggggttatcgcatatatcaattatctgtttggacaggaagaaccgccaaaaggtgaactgagcctttcaagcacaaagctgaatgcagtacgggatggaaacatccagaaaacaccaaatatcacactgtctggagatcacagaaactatgtgacactgagtgtaccagaaaatgtgacagcacataatctttccaaaggaacaagtgttacaaatggaaaaatccagatttatggtggagatacattctatctgtccgcagatttattactgacaggcagttatgcttccggcaacttatatggttctgtcggaaagacatggagaacactggtgttgacaaccggagattccaagcaggatatcggtgtatttgaaagcgaaacagcagcgccggtaagcttcagtgtacagtggctgaatatgacacgcattgaacttatgaagaaagatgtcaatacacagaatccactgtcaggagcagtttatggtatttatactgataagaagtgtgaaaatctgctgatgacaatgtcagcaaccggaacagacggaaaagcagtcagcgattattttgattctgcactgaaaacagtgtacgtgaaagagatcactgctccgacaggatacaaactgaatacagaagtatataaagtggctgttactgccggaaagacaatgactgtaacagcaacagatgagagagtcaccggaaaggtgaaaatcgcaaagatcgataaagaaacacttgcatttaaagcgcagggggacagtgttcttcgtggtgctgtgtatggtctgtatgcaaaagaggacatcgtgcatccggatggcacaacaggggttctgtataaacaggacagcctgattgcacagggagtcatcggagatgacggaacactggaattttcagaattataccttggagaaatgtatgtaaaagaaatcactccaccggaaggatatacactggatactaccaaatacgaggtatcagtaacttatgaaggtcaggatgttgccgaagtgacaagagaccttacggtaaaagagcaggtaaagaaacaggcattccagttaatcaaaatcagtgaagatggagagcagacagaaacagacctggttgcaggagcaggatttaaggtatatctgatcagcgacctgacacaggtaaaaaatggaaaactgaagccagccaatggagaaagctatacagcaagcgatttcaaaaattatgacttcagcaaagagcaggttgcagttacttacgagaatggaacagccgtaccagtaccagaactgatcactgatacaaaaggatatgcagtcagcccggaactgccgtatggaagttatgttgtagtggaaagtactacccctgagaatttgaaaaccattgatccatttgttgtaaatgtggaaaatgacagcagagagccaatgcagtggagagtatttgatgaccgcccgtttgaatttttgctgaaaattgtaaagaaggatgcacagactggaaatactgttttaaaggctggtgcttcttataagatttacgatgtgacaaataagaaatatgtggaacaggttgttcagtatccgaagaaagaaaagatcagtgtattcgaaacaaacgaggaaggatatctgatcacaccgcaggaactgaagtgctctacctaccgaatcgaagaagtgaaagcaccggaaggatttgtaagacagggaagcgaggagtccctgtatgatggaacaacgattatttcaccattagaacagactacaaaaggaacatataaagaaaatccacagagtggtattgtaattacagtatcctcaaacactgcacatcagattgatccagatacaggagctgcgattgtagaggtagaacagaaaaacgatgaacaggtaggaagcctgctcctgacgaaaaagggagaacagcttaccgaagtaaccggagattctgttctggcaaaagtaaaagcactggtttcaaaagtaagaaatgccgtatctggaaaagaagaaacaggtatttataaaggctttaaatatgaagaaaccggagtagaaggcgctgaattcgaaatatatgccaaagataccatctattcaccggacggagcaaaggacgaagcaggaaatccagttgtccgatatgagaaagatgacctggtagccaaactgactacagatgaaaatggaacagcagttatcaacaatctgccactgggaacgtattatctgaaagaagttgtagcaggagagaattttgtcctaaatacagaacagaaagaatttaccctgacagcagaggatgatacacaggcagttgtttatgaaggcgttacctataaaaatgaaagacagaaagttttcgtatcagtagaaaagaaagattctgtcacaggcgaaaagctggaaggtgttatttttggactgtatgctgcagaagatattctttctaatcagggagaggttctcgtagagaaagataccttgctggaaaagaaagcaacggatgcaaagggaacacttactttcgacagtgatcttccacatggaaaatactatgtcaaagaggaagtcagaaaagctggatatcttccaaatgaggaagtatggaatgtagatgcaacttacgaaaatcagaatcttgcaaagattgaactgaacaaagaagttgagaatcagccgacagaaacacgcattacaaaaacagatgcaactaccggaaatgagctggaaggagccaaactgcaggtcattgataaagacggaaatgttgtggaagaatgggtaagcagtaaggaagaacatgtcatttacggactgccggaaggaagttataccttacatgaggaactggctccttatgaagatggctatgtgtctgccagcgatgtgatgtttgaagtcaaagaagatggcagtgtgacaaaggttgagatgaaagatgaatattccaaagtggaaatttcaaaaacagaccttacaaccggaaaagaactggaaggggcaaagcttcagattatccgcaaagacggaactgttctggaagagtggattacagatggaaaaccacattccgttgaaaaactcccagtcaatgaagaacttactctgcgtgagatcacagcaccggatggttacgagattgcggaagatgtcacatttacattgaaagatacaatggaagtccagaaagtagaaatgaaagatgccagaacaccggagaaaacaacagaaaaaacaaatgcaccaaaaacaggtgataaccagaaaatatgggcgtttgttctgcttgcactggcatctgctggaacagctacaggagtgactgtataccgcagaaagaagtcaaaaatgacagacaacaaaaaagaaacagaagaaaaataaaataagaattacaggataaaccaatctgacagggcaggagatgtgcataaagcagcttctgccctgtctgtatataaggagaagaatgatgagacgtttttatacagcagaatcagtaacagaaggacacccagacaaagtatgcgatcagatagcagatgcaatcttagatgaatgtctgcgttacgatccatcttcgagagtggcgtgtgaagtccttgctacaagaggaaatgtgtttgtagcaggagaaatcaccagcggatatgaaccaccagtgtttgatgtgatccgaaaagttttagaagagtgtggatattgtacagatgggatagaaatggatacgtttgtacaccagcagagtccagatattgcgaaagcagtgagtgtgtcgaaagaatttcgggataatatcggcgcaaaattaagagatagaagcaggggagctggagatcagggtgttatggtcggatatgcgtgtgatgatactccgcagcttatgccaatgccgactgttctggcacaccggatcacacgtgaactttcggcttgcagaagaagcggatatatcaaagatatcttttcggatggaaaagcacaggtaaccgtagaatatgaagatggaaaaccagtgagactggaaagtgttgttgtttcctgccagcatggtgcagaaaagagcctgaagaagttagatgccgagattagagagaaagtgcttcgctcagcactcagattactgccgccggatgaggatacgaagattctgattaatccgtcaggaaaatttgtgtgtggagggtttgatgcagataccggactgacggggagaaagctgatggtggatacttatggcagtatgattccgcatggcggcggtgcattttcgggaaaggactgttcgaaagtagaccgttcggcggcttatatggcaaggtatatcgccaaaaatatagtagctgctgagtttgcaagcaagtgtcaggtgtctctggcttatgcaatcggagtagcagaaccggttatgattgaggtagatacctttggtacaggaaaagtgtgtgcagatgattgtctggcggcagcaatcccactggtgtttggagtgacacccgttcagatcatggaatcccttcgattgaatcgtccgattttccggcagacggcagtttttggtcattttggaagaaaggagtttccttgggagcggacagataaggtactggctcttcaggatacgattctgtaatgccttgggtaacagaagaagagattcaggcagcaaaaaatatgactgcgtatgagtatttgcgaacacatcaggcacagagactgcaaaagacaagaaccagaaatgaatggcagttgacggaccatgacagttttaaaatcaatgaattgtcgagtaaatggcattggaaatccagagatatcgggggagtgtctgcactgcggttcctgattgaagtggatggaatgaaatttacagatgctgtaaaactgctgtgcgaagagagtccgtcttttattccgacacagtctgccgaaaaggaaaaaccactatttaaactgccggagagatattgtaattgcagacgaatcagggcttatttaaaccacagaggaatcagcgatgaagtgatcacatattgtatttcacatgaaatcctttatgaaagtgtcccgtaccataacgcagtttttgttgggaaagatgaatccagaaaagcaagatatgcattcctgcgaggaatctatgaaaaaaacgggaagggattcaagatggagcagaccgggagtgaaaaaaagtacagcttttgcattccacctgaaagagaaacaaagcgagttgccgtatatgaagcgtgtattgatgcattggcacacatgacactggaagaaggaaagagggataaatatcgtctttcccttgggggaatcgctgctccgaaagaaaacgcactgatacagagtgaacgttttaaaaagccgccggacgcactggaagagtttctgaagaaccatccggaaatcaaagaaattgaaatatgcaccgataatgactttgccgggagatgggcgaaagaacagatgaaaaaacattacgagggaacgtatcagattatctgcaatctgccggaaaaagaaggggaagattatgcagaccttgcgaaagaaaaaaagcaggcaaataaatgcagggacagaccattggaaagaaggtgatagagaatggaagaaaaaggaacgatgcacgtacatctgttgacggagctgactggaaatctttattcagaagaatccgaatgggaagaagagtggtcggagagtgatgaatatggaatgccattagatggaacagaacttgccgattatgaagaagtcatccgagaagaactggaacgctatggggaagatgatctcatgcagtattttgacggaagtgagtccattcaggaaaagatacaaagtgcagttgttacgatagaaaacaaagacggaatcctgtacggctgtaccaaactggaattaaatgaatttttaagtcaggaagaactacaggaattcaccgaatacattacagggcagtacagtgacgggtggggtgaaggatttgaacagagggatatcaaggtagatggtggaacgatgaatgtgcatttttggcatcctaatatggaacagccgaaaatgtatgaaaagaaaacagagcagattccgacaaagcctgagaaacaacgtcccaagttacagctccttggacatgatgggaatattttttccattatgggcgatgcctcaactcttttgaaaaagaataaacagacagcagaagcaaaagaaatgcgtaaaagggtattggaaagtggggactattacaaagcacttttgattatcagcgaatatgtagaaactgagttgagtccgccgcccaaagaaaataaaaagacaaagaagaaaaatcagccggaacgctgagaaaagaaaggatgatgcctatgacaaatggcctgagtttggaagaacttatgaaagagggaacatacccggaggaatatactgaaggggaaaactggaaaatattacatggagatacattaaaactggtcaaagcattccagccgggaatctttgatgcagttattaccgatccgccgtatgcatccggtggaacaaaacagaatgaaagaaatcgtactacaaatcagaaatacagcagtatgagtgctgccaatgcacttccggatttcgatggggataacaaagaccagagatcttggacgcactggatggctgaatggctctatgatgtgcggaaagcctgcaagaaaggtgctccgatctgtctgttcattgactggcgtcagtatccatcgattaccgatgcattgcagtgggcaggatggatctggcgaggaacagcggtgtgggataagggaaactcccgtccacagaaaggccgtttccgccagcaggctgaatatattgtgtggggcagtaacggaccgatgccgatcaaccgtccggtatcttgtctgccgggcgtcttccgatatggcaatccgcagaaccggattcatgtgacagagaaaccgttgcagcttatgaaagatgttatccagatttgtgaaccgagagggctgatcctggacccgtttgtcggagcaggaacaactgtccttgcagcggttatgacaggttatcgtgcagtgggaattgaggtaacagatgcctactacaaactgggaagtgacagagtgaaaattgcattagaagcagagcagaaagaggatgaaaagtagccgggatgtccaattggacatcttgttttttatagagaaaatgagtggcatccaactggatgcaggaaggagatggagcgtatggaacaggcgctggcttatgtgtgctgttcagcagaagaaagccgggtaaaagtgcagaaatattgcagaaaaatctatgaacttgggtatgtaccaatctgtccgagatttgtattctcaccattcttggaagagtctgatgcagaagatatgcagggatatggaagaatgtcccatatccttttacggagatgccggatggtagtcgtatgtgggaaagaagtgacaggaacaatgaataccgaaatcagtatggcagacagactccatatcatttgtacgacacttgatggactggtacagataaaagaatcaaaataaatcagaatcgagtcaatccggtgctacagaaactggcggtactcgttttgcaagcatagcgtttggatatccaaacgcactttggggagaaccccaatcccccggacacagacggaaatggaaaggaaggatcaagtcatgttaagaaatggagtaatgattgtaatcgcattgatgagcggaggatttataggagtgatagtgacctgttgcatggttgcagcgaaaaaatccgatgaggatcttggcggtatgatgaaagaggaagagaaaaaagaagggacggtgatgcaatgcgaaaacgaaaccatgtgatcccggtacggcttaatgcaagggaagtcagggaactgaatgagcaggtcgaaagaagcggtctgagccgggaagagtttatgcgttcgttgattttaggagcgcaggttcatgcaaaaccctgtgagcatcatcccgaattgctccgaaagattgcaggcttatgcaacaatgccaatcagcttgcacatgttgccaatgcttctggtatggcaagcgagcagagtattcaggaaatgctgcggcttaccaaagagacatggcatctggtaaaggaagagtggtaatgaccgatggcttatacaagtgttatccccgtccaccgcctggaccgttccatcgaatatgtgaaagacaaagaaaaaaccacacagaaagcagactctttggaggctgccattgattatgccatgaaccggacaaagacggaacaggcggtcttcgaagataccatcggatgtaccaatgaaaatgcgtatgcagatatggtggcaacaaaaaagagattccataagatgggcggtgtggaaggataccatctggtacagagttttgcagaaggtgaggtgacaccggaactggcacatctcatcggacaggaactggcagaccggctcttaaagggacagtatgaagtcgttatcacaacgcatctgaataccagacattatcataaccacattgtctggaactctgtgagcatggcagacgggcgtaagtaccacagcaatgcaaagagttattatacggagatccggaagatctccgatgagctgtgcagaaaatatggtctgtctatcattgaatccaatcagaaaaaatcaatcccttatgtacagtggaaagcagaacaggaaggaaagccgacatggagaacggcgatccgtttggatatcagggaatcggtacaggaaagctactcctggtcacaattcctaaaagagatggaaaagcggggttatacatggaaactgaacaggaaatacatttctttaaaagctccgggaatggagcggtatattcgtctgcgttcccttggaaaaaattattctgaagaggaaatacgtgggcagatactacagcccaaggtgaaacgagtctatcaaaaggcagtacagattcatcccaaaaagaaactgaccgggattcaggcactgtattattcctatttatatcaaatgggggtactgccaaaaagaccgaaaaggagtccatacgctgtcagagaggatatccggaaactggatcagaggattgaacagattgagtttttaatgaagcatgacattacgaccagagaacagcttgccacataccgtgagccgttacaaaagcagatttcagaactgatgaaggaacgcagaaagctctatcggaatgacagtgaagacagtggaaaagcacggctgtctgaaatcaatgaggaattaaaaaatctcggaaaagaagtccgtatgaccgtccggattgaaaagcattcattggaaatcgaagaaagacttcgaaaggcagaagaacaaaaccagaatgagaaacgtgtggaacacaaagaaaaagagagtcaggaggtgagataagtatgaattacggagcagaaccggcagatcaggtggtgcggtacagtctggaaggaatggaatactctttgaagattaccggaaatgtggcaaagcatgtggcaatctttattgcggccgccctgaaagatcagaaaaagacaagagggaaaacaaggcttaccagaatgttaaaggaacagcgcccgatgaaattttttaccgttccgggtgaccgcttaaaagaatttgcgaaagaagccaaagcgagaggtatcttatatgttgtcatcaaagataaggtgaatccggatcagacagaggtcatggtatttgcagatgatgcagcaaagatgaaccgggtattagaccggatgaatctggattttgtaaaagcagaatcaggctctatggttacagaagcagtggaaaaagagaatgcaccggaaaaggcagagaaccagatggaaaaagaaaccggggagaatgtacggacagagactgttgtcctgccggaaggcaagatagaatttgaactggatgatgcggaagaaatgttccagatcggggatgaggctttcccggaaggaaattttacacatgcgcaggaggggaaagcaaagaatccgtccgaacctttctcgcgcaacaaaaatatttcttccggtcgggaaactagctgggaagaaaagaatgaaaaaccatctgtgcggaaagaactcggagatatccgtaaggaacaggaagagaaacgtaagaggccggacagacggaaaaatgccagagagagcaggaagaaacgtaagaatatgaaaacgaaaggcaggtaatgtatatggatttaacagacatgatttcaggtggaacggaagaacagcagattcctgaacagaaattgaccaaggaagaatatgcagccaagaagcagcaggaaagagaagaggtatgggctgaagtagattcacaggcacagggagtttttcaggatggagaaaaactgaaaggctttctggattttatggcagagtgtaatacacagagaactccgaatctgcttttgatctacggacagcatccggattttaaggtggtaaggtcttatgaacgctggagagaagaacaccgttcagtaaaagcaggggagcatggcattacttatatgatttccactgaatacgaaaaagacggagaaatgcggagaggatatacgatcggaaaaggatttgacatcagtcagatgtcaggaaagccattagaagaacgcccacagcgaagtctgacagaactggtaggagttgtcttaaaagaccagtcggtgcgtgtacagattgaggataatctgccagacaaagtgcaggcccagtacaatccgagataccgtaccatttatatccgcaacggaatgagtgaagtaacgacattccatgcactgaacagagaactggcatgtgcagcactggaccagcataccggaacctacagccgacagaaagtcagcgcacaggcatattgtgcggcctatgtgattgcaaaacgttatggtgtggatgttaccggattcaatctggagtatattgcacagagaaatgaatgtggaaagaaagatccgcaggaactgagagactttttaaatgatgtccgtcaggcttcctacagtatacgaaaccatatcgaacgcaattttggtgcaaaggaacaggagtatataaccgatgagttcgcaatcggagaccctgtaaaaataccggaaaccaaggatgaaaaaccatctgaacaagtatccggaaaagagaaaaaagcaaagagccagccggaacgataaaagtgaaaaagttggacggttggagtagctattacggaggtcttgtgatatggttggtgtaataaaaaaaggaggtcagccagatgacaaaatactatttgaagatggataacattatgaaaaatatgttcgtggtggcactgaatgatgagctgcaggcacagagtgagcaggatgaatgtttggaagaaacgaaagctcttctgaaaaaagtaagtgaatacgacctcgcccagaaacggctgcagattacagccggggaacaaaggcagatccgtaaggcactgaacaggcttagaagtaaatatcttgcagccggaagatatagtgatggaatagataaaatcattattcaggttgcaaaaccgaataccaccagacacatgttctggtagagaaaggagtggttgattggtcatttattcaagagaaaaagtggcacgacttagagaacaatatccggcaggaacaagaatctgtctggattcgatggacggagaagcgggtatgccgcagggactggaaggaactgtgcagtatgtggatgatgcaggtcagctcggcatcagttgggacaacggcagaagtctctcactgataccgggagtggattcctttcataagaaagaaggacaggaacatccagaagaaaagccacgcaagaaaagagaatctgacttgcagagataagtaaaaaaaagcaggacttggttctgtgtcttgtctttctgccatttgtctggtgggcggcagcgattaccgcttgtgccattgcaccggataagaattttattcaaatcttagaaacgctgagcgaaaaactcgaacagccgttttttatcacgtatacaccgtatacgttcaaatgtattctgatattcacagcagcctatttcttaggcattggtatttatgaatcccaaaaaagaaattatagaagaggtgtggaacatggttccgcaaaatggggcaacgtgtccgaaatctgcagacgttactgcgaaaaacgatacacgcaaaatctgcttttaacacagcatttccgtatgggactggacggctataagcacaaacgaaacctaaatgtgctggtagtcggaggttcaggagctggaaagagccggacgtatgcaatcccaaacatcatgcagtgcaactgttcgatggtgattactgatcccaaggcagaacttttgcgtaaaaccggaggtgttctggaacggaatggatatgaagtccgggtttttgatttgatcaatccggagacttcctggtgttataatccgtttgcgtatgtctgggatgataaggatgtactgaagctgatcaataacctgatccgcaacacaacaccgaagggagcgcagagttcagacccgttctgggagaagtccgagactgcacttttacaggcacttatgctgtatttattgcatgaagctccaccggaagaacagaacttcccgatgatcatggaaatgcttggaagcgcacaggtcaaagaagatgatgaggattaccagtctccattggacattttgtttgaaagactggaaatgcgggacccggagagtattgcggtcaagcagtatgccatttataagcaggcggctggtgttgtatgctctaaaagacttcttaatcaagcggttgggaagtctcttagaacacacaacctaaaaccgaagaaaggagcgcaagttatgagaaaaaacgagaaaatcacagctctgtacgaacgactgagccgtgatgactttggcaaagatgatgaccagcagcgtgagagcaattccatttccaatcaaaaggctatgttggaggagttcgccgcacggcaggggtttacgaacattgtccatttcacggacgatggcattagtggtacttgctttgaccgtcccggatttctggcaatgatgaaagaggtggaagccgggaatgtggagtacctgtgtatcaaggacatgagccgcatgggtcgtgactatctgaaagtcggtcagattatggaaatcctgcgtcagcgtggcgtgcgacttatcgccatcaatgacggcgtggatagtgccagaggtgacgatgattttacccctttccgcaacattatgaacgagtattacgccagagacaccagccgtaaaatccgttccactttccagtccaaaggcaagtccggcaagcacctcacaggcacggtcatttacggctatctctggaacgaagccagagaccaatggttggttgaccccgaagccgctgatgtggtcaagcgcatctttgccatgacgattgagggctacggtccgtatcagatcgccagcaagctgaaagaagaaaaaatcctcattccgtccgcttaccttgcccagcacggcgagggtgtgaataaaaacaagactttcaaagatgtgtacggctggggttcttccaccatctgcaacattcttgaaaagcgtgaatatctgggacacaccatcaacttcaagactcgaaagcacttcaaggacaagaaaagccattatgtcccggaggacgaatggacgattttcgagaatacccatgaagctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgtaccaacaacggcaagcgtatttctcaatatacctgttcacagtacaccaaagttccttgcggaacgctctgcaagacccagcaccgtatcaacgaagatgtggtactgtcccttgtctcggaaatgctgaaagccattgccgattatgcgaagcatgacagagccgagtttgtccgtgtggtgcaggaagcgcagtccagccagcagacggcagaggtcaggaagcagcggacacgccttgccacagcaaagcagagagtttccgagctggaagtcctgctctgcaaaatctatgaggacaacattttaggcaagctgtccgacagcagatacgccactctggacgctcaatacgaaaaggaacagtccgagcttaccgctgaaatctctgttctggaaaaggctgtcaagagctatgagaagcacgaaaaggacgctgaccgttttatcgctctgatcgacaaatatgagaacttcgacaagctgaccattgccatgctcaatgagtttatcgagaaaatccttgtgcatgagcgtgaccgcaaaggcagtatacagaccacacaggaggtcgagatttacttcaattttgttgggcgattcgttccaccggcgtttggagaagtggagcttaccccggaggaattagaggaaatccgcaaacgtgaggaacgcaaggacaggcttcatcagaactacttgaagcggaaagccagcggagcgcagaagcgatacgaggacaaaatcaagaagcggaaaaaggcagaaatcgaagccaagaaagccgccattcgtgcggaggacattgcaaagggcgtgttcgtccctgtcagcagtttaccgcagagagagccgatgaaaggagtacaaacagcatgaatatcacttacacacagaacggcgattatcttatcccaaacatcattatccgcaagaccaagcccctcggacactacggcagacttcgcaaggcgtatctggaaatgcaccgtccgatactgttcaatgagctggtgctatccgacaagctctttgagcattgcgccgagattgacgaaacagcacgaaaccgcatggagctgatcgtgcggtcactggcagagcaaaacggcgtgaccgagcaactgaaagccgaaaaccaaatggaatgggtgcggcagatgaacgcttgcaaggcacaggcagaggagattgtgaaagtggaattgatttatgattgagcgaggaagtccgggcagaaaactgttcggacttttctcagtttgcgcgccatgggcgcgctctaacgggtgtaagtcccgaacacgcccaggtgtagatgttagagttaattactctctaacaactacacttttatggtactaaatggcaattgcgtaactgtagtgcctccaccgggttacacttctgggcattttatttattaacattcgctgccagtcacgacttgaaggaaacaatagataaggattattgtgaatgtggaatgccgttagaaacagttagagagtcagaagcaccgttaaaggaacgaagcgaacgtgtttgaggcgaacgccgagtttgagcgtagttcctttgcttttaggtgattctgactctcttagtgtttcttatggtatggaacctgaacaagaagccttatctattgtttccttcaaggactgagaggccgcttccccagttaataaattaaatcccaattaaatctcaaaatcttttatgtaatctttcatatacctgatcgaatgctctctgtcttccatctccttttgttgttgacagtattgcatgtctctttccgtccggttctgtcaggaataatgtctttttaatattaccttgttttcctacttccagtttctccatctggttcagatcatatatctctacatccgtatctacggtcactacataatcttttgcaatcagaagctgttcttcttttaattccagtacatccggtgctgccagctgacggtagaactcttctttgtctttcactctgtccagctttctgttgaattcttttcttgcttttgtattcaacactgctaaaacaagtcctacacatccaataattgctgccagcatgatattatcaaacgagcagatcaatgccaggcacagaagactgatccagacaatcattcctgtctgtagtgatttgattctttttgctgtcagatctgcatatttttgctgtcctgctgtttcaatcgccatacttttttctccttttaccgaatcttctgctttttccgggtattttcacgccgttaccttgtactctgccgacacttagttaccagcccatggtcttactgtttctttataatatgtaacattttcagaaagaatctttgcctccgcattctttacttctacttctgtcaccgcacagttattgtgcactccgacgccccagtatttttccagcggttcctttctgatgttattcagtatacctgccagcgccgctccgtgtgtggtgatcagtatatttccatacacaccctctgcttttttgtacagactttccagaaactcaccggttcttttccttacatccgcaaatgattcgccaccttttcccggtctgaatcccaccggatcatcgaaaaatttctgaaaatcttccggaagttcccaatgatctcttgcgcagcattttccctcatattcaccgaatgccatttccccaattctggcatccgtgatgatcggaacatctctgccttccagtatgatcctcgctgtttcatacgctctcgacaacggacttgaaatacacagatcgaatgggatatcatgcagcccctccgccgtctcttctgccagatgcttgccaaactgattcagcggaatatccacctgtccctgaatcttttttactttattccaatctgtttctccatgtcttaccagataaagtttcattctaccaattcttcctcctaaaacgacctttttctccattgacctctaatgccaatataactgacagtatatcatatcttttcatctttttatagtcaaattctgctgaaaatgctataatatttctgcataaaattctttaaaattattgaagtaaaagggagtatcaatcatggaaaaaattgcaagctttacagtagatcatctgcgccttgttccgggtgtatatgtttcccgtatcgaccaggcaggcggcaatccaatcacaacttttgatctgcgtatgaccagtcctaacgatgaaccggttatgaatactgccgaagttcacacgatcgaacatctggccgccacattcttacgcaatcatgcagaatatgcagacaagaccatttattttggacctatgggctgccgtacaggattttatctgatccttgtcggaagttatgaatccaaagacatcgtaccattattaaaggaaatgtacagatttatggctgattttgagggtgaagttcccggagcctccgccaaagactgtggaaactatctggatatgaatcttccgatggcaaaatatctgtctaagaagtatcttacagaggttctcgaaaacatcactgatgaacagttacattatccttcctgatcacagttaccgatacattttaactatgagcagcctgtactacaggttgccggaatcaaaaaagcacgcaggaaatcctgcgtgctgaaattttatttttaaattaagctaaagcagcttttgcagcttctgcaagtgttgcaaatccttctgcatcatttacagccatctctgcaagcatctttctgttcatctcgatgttagctacttttaagccgtgcatgaacttgctgtatgacagtccgttcattcttgctgcagcattgatacgagcgatccagagctgacgcatctgacgtttgcgctgttttcttcctgcgtatgaagatgtaagagctctcattacagactgttttgcaactctgtactgtttagaacgtgctcctctgtatccttttgctaattttaaagttctgttatgtctttttttagcgtttaatccgcctttaattcttgccatgtcttattcttcctccttcacaaattgaaccttatcttagagatatggtaataccttcttcatgttctttacattagtagcatcagcaattgttgcttttctaagatttctttttctctttgtagatttcttagttaagatatggctcttgtaagctttatttctttttaattttcctgtacctgtctttttgaagcgctttgcagctgctctattagttttaatttttggcatgatatgctcctccttcaacttgtattgtatttttaacgtttttcagttaaaaccatgctcatgcttctgccttccatcttagccggcttttcaatgactgcgatgtcaccaagcatctgggcaaaatcatccagaatgtgtttgctctgctgaacatgtgccatctcacggcctctaaaacgcagtgtaacctttactttgttacctttactgatgaacttcttagcattattcactttggtattaagatcattcgtctcaatatttggtgaaagacgcacttcttttacttcaacggtcttctgtttctttttagcctctttttcctttcttgcaagttcatatctgtacttaccgtaatcaataatcttgcaaacaggtggctgagcctttggagcaatcttcacaagatccagatctgcttcctgagcaagcttcatagcttccttcggactcatgatacctaactgatctccgttttctccaatcactcgaatttctttgtctctaatctgcccgttaatcattaaatcgctaattgtcgtgcacctccatcataaaataaaaataagtgaatagttcgagactatccacttgcatatctgtatcataagatctataatcaaatctgtatatactcaatatcaaaccattagtcacccgattgtgctaaggtgagagtggatactctactttcttttttgccttacgcaacatataatttatcacattatttttcttatgtcaactgttttttctctttttttcatccttttttgattcctgataattcagcctttattccacgatccagctttccagatcctgtgccccggcatacttttccagatattttctgccatattccaatgctttttcaagaccatcatttcctgaaaatgaatagatcaatgtcaatacttctgtcacatcctccgtgatcattgcacgctctgagtcactggttgaacttccgatggctccgtctttgtctgcgagcaccggaagcgcctcgatcttgatctcatcttttccgattcccttataagtctctcctttctgtccgatccggaataccagttcttctgagatctgagatacgtcataagatcctaccgaaaatcccgattcgatggaaatcaggttattgacatccacaacggtattaacttcatatagtccctttccctgtccgatccggcggatcagtgcctcggaagacacacggtatctgctcggatcctttccgaatgctttgtatgctgccctggattctttcacgtttgggatttcattgatcccgttatcaaaaatagcatctctcgtctttttgaaaatgtctttcttcagatatttccacagttcttcattcttcttttccactttcacccggtactgcaggcatcccactctggtatccggccagatttctttcatcgttttatcaattatcagatgtttcatatatatcgctctcctgtattataaagtgtcggatcatcgttcaggcgaaccgtaagaaatgtgctttgagaatttcccgcataaatacaaaaaaagatgacaatctgcccgtaagcttcttgtcatctttgactcttctttatgctgcttttgatctatttcacagtatattaagcatgcttttctaggcgaaaagacttgttgctccatatattgctactactgcaacgattccccatccgatgatacttaacatactctacacctcctcaggatgatttatttctctctttctgatttcagtatagagcataattatacatttgttaaatgaagcttttgtatgttactattagtattcttaatgtttctatgtatctatctgtggtctgccatgcatacaatggcgatcattccagcgcctgtatgacctccgatcacaggaccgagattgttcatcatgacattggtcacacccattttcttacggacgagttctgcgacataagctgcatcttccggacaattgccatgcgggatcatcaccatatccggcatctttccctcgcatgcttcaaccgccatatccacgatcttattcatgcctttctttctgccccgctctttcctgatgatctgaagctttccttcattatccagacaaatgatcggcttgatctgtaccatcgttccgatcactgctgctgtcttcgagatacgtccgcctttctgcagatgattcagatcctctaccataaagaaatggcagattttcaatttattttcttccacccactgcgcaacttcttccagactcctgccttctttctgaagttccagtgccttataatcaagcaggccttctcccatgcttgcgcaaagtgtatcgatcacaacaatctttctctccggatatttttcacgcagttcctctgcagctatacacatactgttatatgtaccactaagtcctgatgtaaagctcagatgcaaaatatcttttccttttttcaggatcggttccaagatatctattgcagtctgcggacttggctgtgaagtcactgccatctctccgttctctaacataccatagaattcttctgctgtcagatcatacatatcacggtaagtctttccaccgatcgtacagttcagcgggactaccggtatctctctttcccacacccattcttttggcagatcagatgtactgttgatcgttattacatattcactcatatcggaaacctcctcatcctcatcctcatcctcaagtccttttcatcttaccattgtcttacatattacgcaaaacttttttcacagtaatgataaatactgcgctggttgtcaggaccgatatcacatctgctatcggttctgcgcggtagattcccatcacgcccataaattttggcagaataaccgcaagtggaatcagcagaataatcttccttaaaagcgcaatgaataacgatacctttgcctgtccgagcgaaatgaatgatgtctggcatgcgcactggattccgaagatggatattccaaggaaatataccggcataaccttacacgtcagttccagaagtcctttattatccgtaaacagccctgtatatatctgcggtgcaaaaattgccacacctgcaagcagcagtgttcctgtcagacagaccaggatcattcttttcatcgttgctttcacacgttccttatttccagcaccataattatagctgatgatcggctgtatcccctgtgtgatcccctgcaccggaatcgtgatcatctgcatgacactcataaggatcgacatggatcctacatacagatcaccgccatatctctgcagccccgtattcagtgtgatcgttaccaggctttccgtactctgcataataaatggtgagattccaagtcctgcgatcatcttgatcacatcttttttcaaatgcatatttttcaatgtaagacgcatcacgcttttttccgaaaccaggaaatgtaccacccatattgcactgaccgcctgtgacaggaccgttgcaacagccgctccgcgcacacccatatgcagtacaaagatgaacagcggatccaggcagatatttaatactgccccgatcagaacggataacattgcaatctttgcctccccctgtccgctgatgtaagcattcagtccaagtgccagctgtacgaagatggttccgatcagatagatcgatatgtaatctctcgcatagacaatcgttgcatcactggctccaaacgcatacaggaccggtgtcttgaatatcgaaaagaatgctgtcaggattacagaaaagagtaccagaagtcccgcagaattcccaaggatctgttctgccctctgtctgttctgttttcccagttgaatggaagcaagcggtgctccgcccattcccgcaaacgcactgaatgccgagatcatcgtcaggattggaaatgtaaccccgacaccggtcagtgctgcatttccgtatcccggaatatgacctatatacattctgtctactatattataaagcacattgataagctgtgccgccacagaaggaagtgccagagaaaacatcagttttcccagcggtgcacttccgagtctttcatctctgtgattcatttctatctctgcctttcttttgtatacttattatcccattttcctgtaatggtcgtttttcacacacggttatttcaggcttacatgaagatagcttcttccggaaagtgttttattaaagcagatactgcacactaccagaacacatcccattacaaatccccacccgttgaataatgccgtcagtatcagcagggccagacgcatgaacttcagcgcatagccaagttcaaaattcggctgtgtataatttgcaactgcaacaaacgccatatagagcatgacttcgctgttaaaccatcccgattccactgaaaattctcccatgacaagaccagcgatcacactgagcggtgtacttagcatactcggagtgttcaaggccgccaggcgcaggccgtcaattgccacttccagcatcagaagctgatagatcaacggaatattcaccgtatccttcaccgctacaaatgcaaatactttcggcagccagttcggattctgcatgaaaagcagaaagaccggcgtcaggaatatcgtcatcagattaatcagcgttctggatatcttcagatagacactggtcaatgttggaaagtaatagtcatttgcctcttcgatcatatcaaagaccgatgtcggaagtatcatcgcagacggtgaattatctaccagaatcaccactttcccttccagcagacatgccgatgccgtatccggccgttcggtgaatttaaactttggaaacggattataccacttccgcttaaacaggcattccgccaggctctgctgattcatccgcagatcatctgtatctatgctctggatcttatcacgcacatttttcagtaatgccttatcaacccggtcacccatatagcagagtgccacatctgtcctggaactgtcccctacctccatcatctccatgattagtgccggatgccggattcttcttctcatcattgccgtgttatatacgattgtctccacaaaaccatctctggatccccgaagtgacttgtctttatccggctcttctacatttcttgccggatacatcctgcagtcgatcacaatacatgcccggtatccgtcaataaatacgcatgtttcccccgacagcaggcttttcaatatctgatcaaaatcaaacatgacatctaccccaacgtacggaatgcatgcatttgcgaacttccatatatcctccggcatgtcttcttctttcactttaagaagtgcatccatgatcttcagcattgtctcttcacttgtaaaaccatttacataataaaaagaagaaaccctcccgccgatcagcagatccctctggatgaggtcaaagctttcccggatcgggagtgttgcgttcatatatgctacattttcttctcttgtcttaaaaaccgggatttcctgacgcgtcatcttcttaccacctcttacatacatagactgtatgttccagtatgtcccgtttttttcgttcttatacaaaaatggaatgcttctctttccggttatttcgtcgtgctgccaaatccgccgttacggacttcttccacatcatcatcaaccgtaatcccatattccatgaaaatcccctgcataaatcctgttcctgccgggatttccactatttttccttcttttgtgtcattcgtgatcttggcaaaaatgtgtccttcattgtctgaattataataatcactgtcgatgatccctactgtattattcaactgcaggcggaatttgaatccaagtccgcttctcggataacactgaagtacccagttttcttccatcttcgcacggattcctgttggaatcttcgctgtctctcccggctttaatgtgattgcccgcggcgcataaaaatcgtatccagccgatccttttgtcgcacgttttggaagtttcaatgcatcatagatactgcggatgacttcatcggagtcctgtccgatggcatccagatacccttctttaaactgttcaaagcttactttttcaaattttgcgattctctttgccatgtatatatcctcttttctgttatttattctatacttcttaaactacaaaaacacagcctataaagctgtgcttttgttccggcatatccagtataacatcttttagttgccgcactcaatactgatttcattaaataatgtcaggatatcgtctaccgacatcctatctttttcttcttcctttttatccaggatcgtatttccctgatgcatcatcaccaggcggttaccatattcgattgcatatctcaaattgtgtgtaaccatgatcgttgtaagattcttctcttttacaatcttatctgtcagttccatgatcagttctgccgtcttcggatccagtgctgctgtatgttcatccaggatcagaaactcgatcggtgtcatggtagacatcagaagtgccattgcctgacgctgcccgccggacaatgcgccgacttttacatccatcttatcttccagtcccagtccaagctggcttaactgctcccggtaataatctatccttgctttgttcgttcctctggaaagaccgaatacctttcctttattgtctgccagagacatattttccaaaatcgtcattgttggacatgttcccattgccgggttctgatagacacggccgattctttggtttctcttatattctttctgttttgtgatatcggatccattgatcaggatctgtccaccctccaccgggatacttccgcagataatattcaacatggaagtctttccggaaccattacttcccacaacagagacgaattctcctttgtcaatcgtcaggttgaagtcctgaaataagcacatctcattcacggtacccggattgtaatatttatgaattccttttaactcaagcattggtgttcaccttcttctttctgtccatactgatgataagcacaaccaggaacaggactgccgttaccagtttcatggcctgcggatcgaaattgcgtagtgcaacggcaacgcatgctttataaataaccgatccgatcaggactgctgtcgttgtgtgcagcaatgtcatcttacggaaaatactggttccgataattacacttgccagtcctatgaccatagctccggttcccatagaaatttcaaatactctctcttcctgtgcaaatatacatccggccaatgctaccagaccatttgaaactgcaagtccgaggatcttgatattgcccttgtcttttgcgagagacacaaccagtacatcattatccccaacggctcttaacaggaatccggacttcgtattcagataaagatcaagcaatactttacagatcaatgcaagcaccagaacgatgatcaatgtcgcatatggtgcaagtacatccggaatgatcttctccatcagatcattgttaaaaatagtcttctgtgagaataatggcacattcgccgttcctgctatatacagattgatcgtccacaatgctgtcatcattatgattcccgaaagaagatctctgactttacacttcacgtggatcagtccggtacagattcccgcaactgctccggccagaaatgaaagaaccagcgtgatgtatggattcattcctcttgtaaggagggcagctgtgatcgctgcccccagaggaaaacttccatccaccgtaagatcgggaaagtctaatattttatatgtgatataaatccccaatgccaggattccatagatcagaccctgttctaatatcgatgtaatgaaactcatgaaaaatgcctcccaatccactaatttccgtccccaaagctttctactgcgctatttgcaagatcttccggtactgtgatcccaagatcctctgctactttgttatttacatagaatccaggttctgtgatagtttcaaaattctgctcagaagcttttgcttcgccttttaatactttcgccgccatcttaccagtctgctttccaagtgcaatataatcaattccttctgctgcaaggcatccgctcttcacctgctcgatctcacttccgaataccgggatcttcttttcatttgctttatccaggatggttggaagtgatgctacaactgtgttatcagtcagattggtaatacagtctactttgcttaacagatcatccgctgcaagagatacatccgctgttgttgtgattcccttttctaccagttcaaaatcatatttcttaaccagactcttgtattctttgatcgccgatacagaatttgcttcgcttgtagtatacatgataccaatcttcttagcatccggaagcatctcacgaatcattttaagctgttcttcaaccggaagtttatctgatgttccggtcacttctcctaccggttttccatctttgtctgcgagttctgctgctacaggatctgtaactgcagtgtaaatgaccggaatgtcagctttcattgctgcgttatatgcactctgtgcacttggtgttgcgatcgcacataccaggtctactttatcagataccagactgtcggaaatctgttttgcagttcccatatccgctgccgcatttttgtattttacggtaaggttatcaccttctttgattccttctgcttccagtccttttaagaaaccttccctgcagttatcaagagaaccatgttctgcaaactgttcaattccgatggtataagattctttcttatcacttccgggatcggatgaactgccacatcctgctgccattgctgttaccattgccgctgttaataatactgttaccattttctttttcataatttttttctcctctttttctgtataaaatattattgttgtccacagatcccaattgccagttctctgtagttgttaggagagaaaatctttcaccgattaccgtctgccataccatcttagacaaaaagaaaaccgccccaaaccttaaggtttgagacggtaataatatctattattatcgcggtaccactcaaattgacgaatcgtccactttctcatgtactaacatacactcctgattgataacgggttcggttcccgacaagccatactctctcaaacgattgctgaatacaagttcttgatttcagactgccctcaaaagtccattcacttatcaacttcatacagcaatctcaccacctgctgctctcttggatgtcatcgtataagctactcttctttttcaacggtttgctttgttatggttatactttactgtatcaaagttgttttgtcaagaagttttttacttttttcaatcacgccctatttccaggtaaaatccggtgtcccctccaggtcatacggcgtagcctgatacacgtaataattcaaccaattcgtatacaggttattcgctgtcgctctccatgtaagcagcggtcctttctccggatcatcatcctgataataattcttcgggagttcgatcggaagtcccttacttttgtcccgtttatactcaccgtccaatgttatacggtcatattccggatgtcccatcacaaaaatctgacgcccattctgtgccatggcaaggaacagacctacttcgtcagattccgccagaaccgtaatcctctcatccgcatgcactttatccagtggtgtctctgtatgacgggaatgtggtgccagaaatacatcatcaaatccacgtaccagcggaattttccggttcagcactttatgccagaagagaccgaacgccttcttatctaattggaccttgtcaattccgtaatgataatacatgcctgcctgcgctccccagcaaagatgcagtgtagatactacattcgtcttggtccagtccataatacgggtcagttcatcccagtaatccacttcttcgaacggcatctgctctaccggtgctccggtaatgataaatccgtcaaattttttatccttgatctcatcaaatttctgatagaatttgttcaggtggctcactgaagtgttcttcgactgatgtgaagcaaccgcaacaaatgtcacatctacctgaagcggtgtattagacaacgaacgtaatatctgcagttctgtctcctcttttaatggcatcaggtttagaagtccgatcttgatcggacggatatcctgatgcattgcacggtgttcatccatcacaaatatattttcactctctaatatctccttgaccgggagatcattctgcactctgatcggcataatttattcctctttttcctttttattttcttctgtcttctgttcttcattctcggtcatattatcttttttctgaaaatatgtcccatcattatctacataactatctccgttatagcattctgactctgtcggcaatttctttttctccaactgattatccagaaaaagttttacaatataataaatgactgcaaacgccggcactccgaataacattccgagaattccaaataagcctcctccgagaaggatcgatacgattacccagaatgcggacagcccggtagaatttccaagaatcttcggtcccagtatatttccgtcaaactgttgcagcaacaagatgaagatcaggaaatagactcctttcatcggatctgcaagtgcgatcagaaccgcactcggaattgctccgatatatggtccgaagaacggaattacattcgtcacacctacaatcacgctgacaagcattgcatacggcatattcaaaagtgatgtaccaataaagcacaggattccgataatgatagaatcaataatcttaccaatgataaatcccccgaatatctcatttgtctttactgcaatatgaatcaacaggttggcgcgttctgtcggaaagatcgcatatgtcgctttcttactctgattaataaatgtctctttgccgaacaaaatatacacagatacgatcactccgattactgcatggaacaattccataaccagtgtatataatccaaccgtcagatgggtcatcacttcatttactttgttcagaagatccgtacgcatccagttctgaaggcttgtagatgcctcgttcatcgcattcttcaacattgtcgtcatcgccgaatcatccagttgtatatgattcatctgcttcaccagctggttgatctgagccggaagcgtaaagatcagattccggatacttgtgatcagttccgggatcagcatattgataagcgttgttacaatggtgatcagtacgaccaatgccagaatcacccctgcacatcttgataccgtcttcgctttttctttcttcttcatatgcttttccaaaaccggcaccagatatgcatctaccgttctcacgatcggattcaacagatatgcaattccgcatccatacagcaccggcttcaggatagacagtatctttaataccgtatctgaaattgctgtcacacgcagcattgcaaaatagaccagaatacatgcaacgatcaccaggaaatatgtcattccgcggttgaactgctgccttaatttggatggaccctttctcccaaaactgggacggtctttataatatgtattttcttctttgctcataaactcctcttctttcctgcctgtttcgcatataaaatcattatacccttgccgtaaatttacgtcaaccgacaaaaaaggatcagaacaattgtttctataaaacttttataaaaacttatgttctgatcttttttatttctgccccggccgctctatccgttaaagccggtatccggcatctgtcttatcttatgcacatccacacttgaatgttgcacactctgtctcgtcgcaatggcaggcatttccgccttctacactgatctttccggcgtgacactgacattctttattatacatgcagtctgttgccttacagtctacactgctctttgccgatgcctctttcccttccatatccgagtatgcatccgcataggcgcttccgccttttctctcttcaaagctgtcacagcttgtctcagcagctttctttgcagaatttcctcctaccacgatactgtcaagattacagtaataattctgattgtgcgtacaagtctgtacggtacatcgtaaatctggcataatatatcctcctttcaaatacaagatatattatgccagttctttttatttcttatacatttgtaaaaacaaattagttttcttcttttacaacttctcgtctttctcttgttgcgatttcttctgcaacagatgctacgaacgcatccagactcttctggccttcatctcctgcaaatctgcttcttacggataccagattttcttcttcttcttttgctcctactacaagcatgtatggaatcttctgcatctgagcctcacggatcttataaccgatcttttccgcacgtgtatcaatctctgcacggatacctgccgcatttaatgtctccagtactttctgtccgtattccagatgtttatctgagattggaagcaccttaacctgtaccggtgcaagccatgtagggaatgctcccgcaaaatgttcgatcaggattccgatgaatctctcgatggatccaaatgctacacggtggatcatgatcggacggtgtttctctccgtctgcacctgtatattccagttcaaatctctgtggaagctgcatatcaagctgaattgttccgcactgccatgttcttccgatagagtctgtcagatggaaatcaatctttggtccgtagaatgctccgtctccttcatttactacataatcaagaccaagatcattcagtgcgccgcgaagaccttctgttgcaagttcccaatcttcgtcacttcccatactgtcttccggacgtgtagaaagttctacatgatacttgaatccgaacagctgatatacttcatcaatcagcgctacaacacctttgatctcatcacggatctgttccggcatcataaagatatgtgcatcatcctgtgtgaaacagcgcacacgcatcagaccatgtaactgtcctgatttttcatgacggtgaaccagtccgagctctccgacacgaagcgggagatctttatatgaacgtggctcagctttatatacgagcattccacccggacagttcattggcttgattgcaaagtcctctccgtcaatctgtgttgtatacatattttctttataatgatcccagtgaccggatgtctcccagaggtgtctgcttaagattaccggcgtagatacttctacataacctgcttttttgtgaagttctctccagtaatcaagcaatgtattcttaagcaccattccctttggaaggaagaacgggaatcccggaccttcttcgcacatcatgaaaagtccaagttctttgccaagttttctgtggtcacgtttctttgcttcttcaagcattgtcagatattcatctaactgtgctttcttaggataagagataccgtagattcttgtgagcatcttgttcttctcgctgcctctccagtaagcacctgcaaggcttgtaagcttgaatgcttttaccggctttgttgtcatcaggtgtggtccggcacataaatcaacgaattctccctgctgataaaagctgatctcttctccttccggaaggtcttcgatcaattcaactttatatggttcatctttttctttgaaatatgcgattgcatcttctcttgtctttgtaaatcgttcgatcggaagagcttctttgacaatcttcttcatctctttttcaatcttttcgagatcttctgctacgaatggtgtctcacggtctacatcatagtagaatccattctcgatcgacggtccgatcgcaagctttgtatccggatacagacgtttgattgcctgtgccataatatgagatgtggtatgccagaaagcaccctttccttcttcgttatcaaatgtaagtatctccagttcacaatcttcatccacaacatgtctgagatctactacttcaccatttactcttgcggaagttgccacccttgccagaccttcgctgatatcttttgtaatatccagtactgacatacttccttcatactctttgaaagatccatcttttaatgtgattttcataattatcatgtcctctctttttattttctattctatcctcgggcatgcatcttcttttctgcccgttcagcaatcacctgtaatctgcggtttctattgtatgctttgtcagcttctttcaaacgcatggcaataaaaaattcccttacagacaaatgctgtaagggacgagttttctcgcggttccaccctgtttgaactgacgcatcaaagtctcttcatttttcaaagacctctcatgtcagaacctcttaattatgacgataacggaatcaccggactgttttgcagccactcagaggtagttttcagaaggttccaaaataagaagctttcagcctgcggcttctctctctggcatttctttcccagcctactcttctcttcaacgtgttttttatacgctctcattatagcacgaggttttactttgtcaacattttttcaaccacagtttccagaccgcaaaacattcccgtacaaaataattgggaaatagtaatggatgacagcctgccgctatcggaaatggattcttaaatcctgcgcgttttgcatacacacatccccggtatacatgaaaattattcgagacaataccgaccggtgtatccacatctgcaatcagttttctggaaaacttcagattctccagtgtatttaccgatgcgtcttcctgtataatgcgtctgcagtcgatccctgcacgctccagatactgcgccattgcatacgcttctgttacttcttcatcgttcccctgtccgccggagacgattacatgtacatctgggtgctctttcagatactctaatgcagaatccagtcttcgtttcagtgaatcggtaatcttccggcctctcacctgcgctcccagcacaatgatccatcttgtgccggatcgtgtatcttcttccggtcttttttccaaaggccttctgcacattcctgttatgatctttatctcagcaatcagaaggaggcatacagcaataccgatcagcgcttctaccacacacggcattccatacaaacggatcaaaacgcttcctgcgatccccacaattccggccgccagccagaatctggaaaaagtagagtcccattttttcagtgcgatacagatcgcactgtaataaatgagactcaggatacctgcagccagaaaaattatctgccacagcattttttatattttttacctgatccgcacggacatggatcatttcttccaattttctttggtttacgaattgttgtagattctttctgttctttatagaatttttttaattcttcttcagaaaaaatctctttccactgtggaagttcatacagccagtcagctttcgctgctaccatattcttgtacagtctctctttatcaaatgcaaggcttattactgtatcttcttctactgtatccagatccagttcgatcagaaggctttcattgattccatccaggaaaccgatcatggtcagaacttcctgtccgaacttctcagccagttctttgactgttcctttcactgcttcatccggattagaaagaagcttttcgtaaatctctttctcaatttggaaatatgttccccagaatttttccaactgacttctgtctgcagtctcatcataagcgatgttctgccactgctgatataatgtgctcatatttctatactcctttgtacgatattcatttgcaatttttcactgctctctatataatatactaaagtcttgattcattgtaaaggatgattattatgaaaaatgcaaaacgtattctggcactcattgccgctattttattattcggtatgtatctcagtacattaatatttgccctgatgggaagtccacattctatcgaccttctctgggcatctgttgcatgtacgatcatacttcctgtacttttatacgcttatacgctggtatttaagcttacccgccacgatgaccctgaccaggatcacgaccatgcaagcgatgataccatatagaattccagaggcatcagactttcttctcgatcgtctgatccttttttcttgtgttttctttcgttttctcttattttctttctctttgcaaggtattcttccattgaaattacttctgcttcttcttttgtcaggtctcttgtattcattgtgcatacctccatcttgattatttgtatcccctcttacgtctctggtgtctgattacaccgacgttattattatatttacgatgatcttattatatgcatattttgtggcaacattatggcagaaatctaaataaagcatgagaaatttcttaaggaaaacataactctgatctgaagaatccctccctgactgtttcttcggaatgtatgaatactcaaaaaacagcagctataagtctacttttatcttatagctgctgtcttcatctctctcttattttgaaagttttgactctctgtaaataatgtcgtgtctttctggtccgttagataccattgtaatcgggtatccaatctgctcttctacaaactcaatgtattttctgcagttttccggaaggtcttcgtatttcttaattccacgaatgtcacatttccatcccggaagtttcttaagaactggttttgccttctctaacagatgtgtcgttgggaattctgttgttacttctccgtcgatatcgtatcctacacataccggaatctcatccagatatccaagtacatctaatactgtaaatgcaacatctgttgctccctgcattctgcatccatacttggaagcgacacaatcgaaccatcccattcttctcgggcgtccggttgttgctccgaattctccgccatcaccaccgcggcgtcttaattcgtctgcttcgtcaccaaagatctcacttacgaatgctccggctcctactgcacttgaatatgctttacatactgttacgatcttcttgatctcatacggagggattcctgctccaatcgctccatatcctgccagtgtagaagatgaagtaaccattggatagattccgtgatccggatccttcagtgatccaagctgtccctctaacaatacttcttttccttctttgagcgcattgttcaggaaaagagaagtatcacatacgaatggttcaaccatcttcttatattcttgaagttcattatataaatcatcaggattgatcaatggtttatgataaaggtgctccagtaatacattcttctgctctgctacacgaacaactttttcttttaacagttcatcatcaaacagctcactgacctggaatccgatctttgcatatttgtctgagtagaatggtgcgatacctgattttgtagaaccgaaagattttcctcccagtctttcctcttcgtatgcatcaaaattcttatgataggacattaccatctgagctctgtcagataccagaatcttcggcatcggaactccctgatcgatgatagactgtacttctttaaataataccggcacatccagtgctacaccatttccgataatacttgtcgtatgatcgtaaaatactcctgatggaagtgtgtgtaatgcaaactttccataatcattgataattgtatgacctgcattcgcgcctccctggaatcttacgatgatatcagcctgttcagccagcatatctgtaatcttaccttttccttcgtcgccccagttggcaccgactactgctttaaccatatccattcctcctgcgatattaacatgacttatcagtcttctttagcggatctaatcaaaccaccctaagcattatactatacatttcaccttggttcaataacatttttacataaaatccacaggatttcctgtgttttctacattagcggcgcaaccagtcttaatacctgtcccgccgtcttcatcagaattcctctgtttctcacttccgtcactgtaaccttatgacattttgccagcgtattctgaaaatcttcttctactttctgcacttcaggattatcgtagataaacacaccattctcaaaatgcagatacaggcttctgaaatccagattgatacttcctaccgttgccgtatcatcatcggatacaaatatttttgcatgtacaaatccaggtgtatactcatagatctgtaccccgccctcgatcagttccttatagtaggtctttgccacagcaaatgcataccacttatccggaatatgcggcatgatgatgatcacctcaataccactcttcgctgcacggatcagtgtagtaagcatctcattgtccaagatcagatacggggtcatgatatgcacatatttttttgcatggttcaaaatatggaaatatacttcttctcctacattttcatgatcaaacgggctgtctgcatatggaatcacatatcccagtttttcattcaatgtatccgcttttttggtcagatattttccataaggctccacgccccgcatatccacatcccacatctgcagaaatatcatcgtcaggctctggacagcatcacctcttaacagtaccgccgtatccttccagtgtccgaaccgttccttctcattgatatactcatcagcaagattcacaccccctacatatcccacctgtccatcgatcacgcagatctttctgtgatcacggttgttctggattgttgagacaaatggccggatcttattcgacatcttgcagttgataccgtatttctgaagtttcttcggatagctgtacggcagcaggtcaaatgcacacattccgtcatacatgaaccggacttccacaccttccgctgctttccgcttcaggatctcaaggatcgtattccacataataccttcttctacgatgaagtactccatgaaaataaacttttccgccttttccagttcttttatcatggatgcgaatttggcttctccaaccggaaaatattcggcttctgtattcctgtaagtcgggaatcccagttgatgcgacagataatacgacagctgtgcatttgcagattttccctcccagagtgcatctgtgatcttctgatcctgatccatgtaaggttccgtctccatacgcaatgccgccaggcggttctgtacaaaccgtgtttccagctgcagatgcacatagatgtaaaatatcgtcccgacaaccggtactgccatcacacacagaatccatgacagcttgaacgccggatttccctctgtattaataatatacacaagaactataatctccatcagagacatcacactgtatataaatgttgcatattctttcagatagtacggaatccccagaaaaaccagcatctgtatcaatatcagtatcacaaaaattccggcacggctgaataccattttaaagaatttcttctttgcaacagtctttgtgctttgttctttcatactttttctctcctttatccagggctgtacatccactttgttcctaatatcttactccgttttctcaggctccgtaccgccaggatatgttatacagtgtatcatattttcattttcttctcaacttgcagataatttattttaatttaatagaaaaatacatataatatgtgctatgataaggaaaagaatggaaaggagtcatacaatcatggcaaaatggatgaaaaaattattgggtcttgctgcaatcggcagtgccgctgcaggtcttgtttattattttaaaaaatctaaaaaagatgtggatgaagatttcaacgatgattttgaagatgaagacttcgatcttgacaatgatcttcaaccggtcgaccggggatacgttgatctgaacgcaggaaaatcttctccggaagaagcagacgatgcagaagaaacagaagaaacagagaccggcgaagatactctggatgcggatgctcacgaagggaaagaagattagttctgctgacacagactgaattcagactgcagctatacaaaagagcagtaaacaatgtaaattattttcttattttacattgtttactgctcttttatcttctccaacacctgttcaaaattcccactgcttctttgatatcctcttcattcatatttgcatatcccagaagaatcgttgcccgctcatctgtatctttcctgatcctgtaatccgaaagtccatatacacggatatcctctttttttgcccgttcgatcagatcattttcgttccatcccttttcaaatgtcagcaggatatgtactcccgcatgctctcccgatatcgcacagatatctgccagaggcttcagtgcatcgatcagaatatcgtgcctgtttttatacagagctcttgtcttattcaaatgacgttcgtaatatccatcttcgataaaatgttgtacgatcatctgatctacctttgaaacggttgagttgataaagttcacatttgtccgatacgcatccaggagagattttggcagtaccatataactcagacgaatagccggtgcaatggattttgaaaaagttcccagatagataactttatcttctgcatcatatccttgcagagccgggatcggtttccctttgtagcggaattcactgtcatagtcgtcttctatgatatatctgccttccttcccgtatgcccacttcagaagctccattcttcttttgatcggcataacgattcctgtcggatactgatgcgacggtgtgacatatgcaatatctgcctctgaatcttccagctctgatattctcattccattgtgatccattgtaaccggcactgtctcatatcccagtgtctgaatcactctatatgcctgcttgtatgtaggatcttcaaatgcaatagtatgttcttttccaaggatcatactaagcagtatcagaatataatcacttcccgctccgatcacgatctgctccggagaacagtccacgcctcgtgcctgatacagataattgcagatggctccccggaatccatattcaccttgcggatctcctgaacggaacaactccgtcctgtcatccagcaaaatgtctttcgaaagttttctccagacattatatggaaaactgttaagatctactccgttcggtgtgaaatcatagcggtatattcttttcttttctctcttacgttccggctttttttcttcttttttcagttgatataattcatcaatctgagccacaaaaaaaccgcgatatggcgcagactcgatatatccttctgataataactgttcatatgccagttcaaccgtactgcggctgacttccagatgcttggacaaagccctggtagacgggagtttctccccatagcggagtctcccgttctggatatcagacttgatatgatcataaatctgctcatacagcggcttcttcgaacgactgttaagatttatcgttaattcattcatttttttattttgcacccgtttatttctttggcagtttaaaagaactcttcagagatacaatacggttaaacaccagattttccggtgtggagtctttcgaatcaatacagaaatatccatttcttacaaactggaagctgtcacacggacctgcttcgttaaagctgtcttccacatagcactcttttaaaatctgtaaggaatccgggttcaggttcagcgatccatcttctttattatatactcccttctcttcatcgatcaggttctcatataatctgacttctgctttcttagcctgtggtgcacttacccagtggatcgttccttttaccttacgtccggtaaacccggttccgcattttgtctccggatcatacgtacaatgtaccaccgttacatttccttctgcatccgtctcatagctgacacattttacaaaatatgcatgcatcagacgtacttcgtttccagggaaaaggcggaaatacttcttcggaggatcaatcataaaatcattacgctcaatgtaaagttcacgtccaaacggcacttttctcacaccaagttccggattttccagattgttctctacatccagatattccacttctccttccggatagttgtcgatcaccagtttgatcggatccaggactgccatcatacgaggcttcttcatcttcagatcttcacggatacaatactccagcattgcataatccacagagctctggctcttggatactccgcacatttcaacgaacatcttaatggattccggtgtaaatcctcttcttctgagagctgcgattgatacaagtctcggatcatcccatccgtctacaataccatccataacaagcttcttgatgtatctcttacctgtaacaacattcgtcagatacagctttgagaattcaatctgtctcggtgccggatcaaattcacactcttttacaacccagtcatataatggtctgtggtcttcaaattccagtgtacagatagaatgtgtaatgtgctcgatcgcatcttcgatcggatgtgcgaaatcatacattggataaatacaccatttatctcctgtattgtgatgtgtcatatgcgccacacggtagatgatcggatcacgcatgttgatattcggcgatgccatatcaatctttgcacgcagaactttctctccatcctgatactttccgtctttcatctcttcgaaaagtcttaaattctcttctatcggacggtcacgatacggactgttctttccaggctctgtcagggttccgcggtattcacgcatttcttccgctgtcaggtcacagacgaatgcctttccttttttgatcagctttactgcacactcatacatctggtcaaaatagtctgatgcaaaataaagatgatctccccagtcggcacccagccattttacatcttctttaatggactctacgaattccatatcttctttcatcgggttcgtatcgtcaaatcttaaatgaaaggttccgttatatttctttgcaagtcctgaattcagaagaatcgacttcgcatgtccgatatgcagatatccgttcggttccggcggaaatctcgtacatacttcactgtatactccttctgcaagatctttatctatttcctgttcaataaaatttttggaaactgttgtttcttctcccatggtgtcctccttaggttttaactatacattatgctcattatcttatcataaaaaatatgatgaaacaagggaagatacctcttttaccggttttcgcagaaaaatgtaaatgcatccagaaattcagaattacttgggcacttgatcgcatggtaaccaaggatctccatcataagttctttatcttctttccaacacttatcaacgactacacgtatcccgcgttccacattataaaaactggtttcgtgtttttctcctatcgggatatatatatcattctgtgtcgcaaacggcttttcttttgtatggaatccactgatgatatctgcagcatccaacagataatagtatcctttatatcctgatgtgactttaaatcttctgagtgtctgtatcataatattcctattcataaataatctcccttttttggctctatctaaaaaataaatcacaacatgtcgtttgtcaatgatttcgataccaaaaacctcttttttttattttttagacctttatgtgtctgatttcttcgaaaaagatcagctataggtcaaaaaaagtttgaagacatctttttatcttcaaacttttttgcatttgtctatatcttttccgtccttaaaaccatccattttcctttccagacatacagaatcatcaaaagcatgcccaaaagccatgaggtcggatagcacatcatcacatgaccgagactctttgcccatgccatggttcctgcaatccacatcacacggaatccgcataacgataccagaaatacaatcatggcctgcatcgtcttgccggttcctctgatcgttccgccaagcacatgcaggattccaagcatccagtaaaacgggcagaaatatttcataatatatacaccatattccaccaccttatggttcgtcgtaaagactccgattacctgcggagcgaatatcagcagcacaattccggttatcacagaatacccggcacccattgctgtggatatgtacattccttttctgaccctgtctgctttccctgcaccaatattctgtccggcaaatgtagttgccgccatactgatactcagtaccggcaggatattaaatccatcgatttttatataagctgcaaaacctgccataactgtcgctccaaaactattcacacttgcctgcacgatcaggtttgaaagcgaaattacaatattctggattcctgtcgggattccgatgcggatgatcttcgaaagcagatgatcatagcatcggatctccttaatcttcaacttatatacatcttcacttctaatcagaaatccccatataaaaatgcatgatatcaactgactgatatccgtagccagtgccgcgccaacgattccaagcttcagtccgacaaccatgatcagatccaggaatatatttgaaatcgccgcgatcatcaggtataccagggaacgtctggaattgcccacggcattcagaacacccgccgacatattgtaaactaccgaaaacaaacttccgccaaaatatacctgcagataaattaccgactgttcaaataccttgtccggtgttcccatcaggcgcagcatcgatggtgtcactgtaattccgattacagtcagaagcactcctgctgccagcgcgatcgccatcgtagtatgtacggccttcctcacaccttctgtatttttggccccataaaactgcgagattacaacacctgcaccagtcgatgctcctatgcagaaaccgatcagcaggttaatgattgcaccgctggatccgactgctgccagtgcgttacttcccacatagttgccgacaataatcgaatccaccgtattatacagctgctgaaacagattccccagaatcagtggaattgcaaagaatagtatttctttccaaatcactccttcggtcattgttttcatctttttcattttcttcttcctctctattactatttcttttcatattcctgattttcgcaggatttttcacgattttcaattaatatcacgaaaatatattgacaaatgtactcctttcagtgtatagtatcaacgttgcatatcacttatgcatgctgccttggctcagtcggtagagcgtcgccttggtaaggcggaggtcggcggttcgattccgctaggcagcttacaagagaagtcccgtaaaactttcaaatgattgttttacgggatttttttacaattacaaattcagccgatatttatatcctctttagatttatttttccttttccagaatcttctgcatctttcccttgattctctgaagtgcattatcaatcgtctttggactccggtctagaagctttgcaatcgtcttataatccgttcccatcagatgaagatacagaactctgcgctccagttcacttaattctttttccagacgttcttccaacgtcttcgcacgttcctgactgacaagcagttcttccggattcgtctcatgtccggattccattgtatcgatcaacgagttttccccgtcttctctttcatacagggaaatataactgttgagcggactgtgtttctttctgtttgaagcttcaattgccgaatacaactgtcttgtcacacatagccttgcaaagctgaagaaggatgcttcctgatccacatcgtagtcctgaactgctttaaaaagtccgatcatcccctcctggatcagatcatccgtctcaccgccgagcagatacattgcattggcttcttttctgaccagattcttatatttttccatcagataatcgataattcccgtttctcccatccggagtctgcggatcagttcttcatctgttaattttttatactctgtcatacactcctctgtctcacaatctcatatgcaaggacgcccgctgccaccgatgcattcagggaatcgatatcccccttcatcggaattcttgcagtaaagtcacaggtgtcttttaccagacgtcccacaccttcgccttcattaccaattacgagtccgatcggtcctttcatattgacatcatacatgacatccccgtccatatcggcacatacgaaccacagaccttttttcttcaaatcttccatcgtctttaccagatttgttacttttgcaaccggtgtataattcagggcccctgcggaagttcttgctacggttgccgtcagtccgactgcccgtctctttggtatgatcacaccgtgtgcccctgcctggttcgcagtacggatgatcgcaccgagattgtgcggatcttcaatattatccagaatgatcagaaacggatcttctcccttttcttctgcaagctttaacatatcctctacctctgcatattcatatgcagcaacacttgcgatcactccctggtgtttaccggtctccgacaactggttcagacggtctttttccacgaaattcaatatcgtgtcatgctttcttgcctcgcggatgatggatctcaccgcaccatcctgacatccatccagtacatacagcttgtctaccggtttcccggaacgaaatgcttccataacggcatttcttccttctatgatactttcatttacattcttatcgtgactcatatttgacactccttattattctttgatactgtccagacctattttaaccagttccagcattcttttccactcttttttcagatatagatatccaagcagagcttcaaatcccgtcgcacgtctgtaatctgtaatcgactggttcttcgccggcgacacgctcttggcattgcggcctcttttatagacagcatgttcttcttctgtcaggtgttcctgcatcgtacgcatcattttcgactgtgcggacgcctggacataagagctagtcttctggtgcagcttctgtacctgacggtttccttcattgatcaccagggatttaatgatcagatcataaatgcagtctccgatatatgccaaagtaagaggtgaatattctttaatatccacctctttcatctggaaaatctcctgcatataagtgtcaaatccccactctacgctcttttccattgtactccttctctggtatcctttaagatgatacccttctctaacagttcatcacggattgcatcggctcttgcaaagtctttagccttacgtgctgcctgacgctcctcgatcagtttctcgatgtcttcgtccaggatctcttctttcttatctacgatcagtcccagaactcctgttaacttcacaagcaaatcgaataatttctgaagatattctttggaactttctgcatcggttgttgtattgatatattttacaaggtcaaagattgctgcaacggcatctgctgtattgaagtcatcgtccattgccttttcaaatcctgcaacaaactcttctgtttttgtaaagttttctgcttctgcatctgtgattgcttctgcttttgcatttcccataaggaacttcagattatctgctgcatttacgatacgctccagaccattcttggatgcttccatcagatctgcactgaaattcagtgggcttctgtaatgtgcactcagcatgaagaaacgaagtacctgcagatcgtactgttcgctgatctcacgtacggtacggaagtttccgagagatttactcatctttctgttatcaatgttcaggaatgcattgtgcatccagtatcttgcaaattccttgccatttgcggcctcactctgcgcaatctcattttcatgatgtgggaatacaagatcttctccgccggcatgaatgtcgatctgctctccgagatatttcttagacatctctgaacactcgatgtgccatcccggacgtccttcgctccacggagactcccatgcaggctctccttctttcttcggtttccaaagtacaaaatccagcggatcttctttctcatcttctccggataccagaagggaacgttcacccgaacgaagatcatccagattcttgtgcgaaagcttaccgtaatctttgaactttcttgtactgtaatatacggtaccattcttctcatatgcaaatcctttatcaatcaacgtctggatcatatctaccataccgcagatttcttccgtcgcaagcggattcttggttgccggtttgatattcataccgtccatatcttttttacactctgcaatgtaacgtttggaaatctcatcggctgtcaccccttcttcgatggcttttttgatgatcttatcgtctacgtctgtaaagttggatacataattcacatcatatcctttgtattcaaaatatcttctgaccgtgtcgaatacgatcattggtctggcatttccaatatggataaagttatatacggtaggcccgcatacatacatctttacctttccttcttccaaaggtataaattcttcttttttctttgtcattgtattaaaaatcttcatttttcgcgttctcctcctctttttcttccggtatcggattctcttttaaacattgcatgcgtttctccatctcctggatctgtctgtgcattcttatgttatctgcctgcagttctctgatatcatttgaaatcggatccggcagatgcacctgatccatatcgagtctcggtatcttctcatcattcatcttaaccactctgcccggcacacctacaactgtacaattcggcggtacttcttccaatactaccgatcccgctccaatcttggaattttctccgatggtaaatgaaccaagaacctttgctcctgcactcaccataacgttatctctcagggtcggatgtctcttgccttgttcttttccggttcctccaagtgtgactccttgatacaaggtaatattatctcccagttccgcagtctctccgatgatcactccgcttccgtggtcgataaataatccttttcctattgttgcccccggatggatctcgattccggtctttcttactgcccgttgcgatacccatctggcaagaaaataatgtttcttcagatagagcttatgtgcgattctgtaatgaagaattgctttgaaactagaatacaggaatacttccatattcgacttgatcgcaggatcccgttcccgtatcacctgaatttcttcattgacatatgatatgatgcccatctatgatctctcctttttataagtttaccgcctgttctgtatgctttggtacaaaaaaactccgtctcctgctttacacaagagacgaagtatatccgcggttccactctttttaaagaatacagttctattacccgcattcttctctcagtacacgtaacgtgtgtaatcccggatccggctatgatgttatccttctttctcaccggaccgactcccggacgcacttcacaaaagctgtaatcggaaactgctttcagccggtgacagtttctctctttcgacacaacacatctgctactctttccgttcaaagtctttctcatatagaatatatattatgcgatatcatcttttttgtcaaccagtttccatcggatctctgctttaaaaagatctgcttccgtctcgatccagaactttcctttctgaatttccacaaagctcttaacaattgcaagtccgagtccggatccttcggtatttcttgccgaatcgcctctgacaaaacgctccgtaatctcttccggattaaatgtaagctcggtggccgatacattcttcatccggaataccgcctcaccctcttccgctgcaatcttcacgtatactcttgtatgaggcattgcatatttcactgcatttccgatcagattctcgaatatccggtatgtcttctgtccatccagcgccacgatcactttctcctccggaatatccagacggaaatccagattcgcttccgtaatcttttcttccatttctaatttcacctgtttaaaaagattcacaatatccatctcgataatattcaggttcaccgaacggctgctcgctttactgatttcaaacaaatcttcaatcaatgcttttaaccggagtgattttctatccagtacatcaatgtattctttctgtctttccggatcatgttccatcttcagcagattcacataggtgataatcgcagtcaatggagtcttcagatcatgcgagacattcgtcaccagttcggtcttcatccgctggcttttcacttcttcatctaccgctttcttgaatccggtctgtatcttctcaatctcttctttaaacggctcgaacacccccagattttcatcaatctccacatccagatttccatcggcaatctcatttgtcgcttctaacagtctgtgatagtttttctttatttcattaaaatatttcttcaaaataaagtatagaattaccgaatatatgatcagtgccataattccataaaaccagaaaatactcgtcactgccagaatgataaagttcacaagcacaatcctcagaattgccttactgcttttgtctgtaaagtcgatatctgtaatggtctgatacagcctgtgtgccatttctttcactttccggtacaatcttccgctgtctcgtccgactctttccgctgctgccggagcttctttcctcagcgttttccacatacgccacaacagcgtccgctctgtaacatactttctgacaccagtcttctgtatttcactgacacagcttgctgcccagtatgtgacagcaaatgctgcaatccagattgcggcgtccatcgccccgggccttcccttcgtccttgttacaatccagttcagcttattgtccaaaagtcccagtcctgttaccgcaacgataaaaacaatctcaaacggctgttgaaaaagctttctgccgccaatccccagcgtatcactttgtgcaaaaatccatgctgccacacctaccgctgccatgcaggcaagcatcatataccatgcatcattcggcgcttcatccccgaaccagtaccattggttcagatattgttcaattccgtttttcttcattccatagatatatgtacggttcttcggcgtcttcaattcgccgccggtggcatcctcaaccgtctcactccagttatctataatctttctgagagcaatactctgcgttgtcttttcactgctctttacaacttttacatccagatctccgtgttcatcataagtcagtaccataccaaatgcatattctttgaaactgtcatctgccagaccctttccggtattcgctgtgcttcgtcccaggactgcccctgatccatcctcaatcctgtaatccagatatggatataacgcttcataatcctccatccatacttctgcagcatcgctgatctcctcctgagacatttttgcttctcctgtcttggatgatatctcctgattataaaggacataactgaattccagaaagctttccagatattccctgtctgaaagtgaagttgtataagtcttctgcgcttcactgactgcttttctatatatcgtatgataattatatatcatgaaaaacgctgctccaagtatcgtcacagcagcaagaaaaagtcccagtttacgcctgtttttcaattttgtatccaacgccccacaccacctttaagtattttggttctcttggatttacttctatcttttcacggatatttctgacgtgcaccatgatcgtatcggtgttaatcgcacgttcattccatacccgctcatagatctcctccgcagagaacacccgtcccggattcttcatcagaagcagcaggatcttgtactcgatcggagtcatctttaccggttcgccgtcaacggtcacttctacattatcctcattgatctccagtccgcctatcgtatggatcctggaattttcgttcttatcctccagccgttccataaacctgcggtatctgcgaagctgcgaattgactctggcaagcagttccatcggagtaaatggctttgtcacataatcgtcagcccccatattcaatcccatgatcttatccacttcttctgattttgcagaaagaaaaatcaccgggaaatcatacttctccctgagttttacgaccatagagattccatccattaccggcatcatgatatccacgattgccagatgaatatcttccctttctataacatccagtccttctgcaccatcagccgcctgaaatacttcatagccctgactcttcagatatatctccacgccttccctgatttccttgtcgtcttctacgaccagtacatgattcatctccatcacatttttcatccttttcctgattccagcttttccctctgttattatcatcctatccggtatttcttaagggtgacttcagaaaattctaaagaaaaacaaaagattcttctttataccgtttcattcagataaatctgtgacaatggaatgatcttatctaattcttctttcattcgatccgacatgaccgcatcaccgtccgcacagatttcttctgcggtcttcacaccgaatacaaggctcgtaagcgccgctacggtgagtgttccttcactgttttccggctttccatccatcagcatcactcccgaaaattctgtccccgtaatcatgacacatcggttattttctttgataaccggatctgtcaccgtaaaacatgttcccataaatgttttgagtctcaaagacatcagcatccgtctgacatctatgatacgaatcataatcttaggtttttccccatctacttcttcagcctctgctgcgatcttaatatctgtgaccgctccttcttttttatatatctttaacgtccctccgtcacttgcatattctttgatcagacgttcataataagctgtatttctttttgcgtagacctgatacgactgcgacagcctgccttccatataaacagccattttttctgcatcttccactgaggcatccgtcacatctgtaccttcttccacttccgcttccggatcataatatgcccgattctgttcatacaccgtccggaaatcaaatggcagatagatgctctccgatgccggcatcagaaatgtaaatgtctctccgtctgcatacatatcatttaacgcctgtttcaacattcctgccataaagccacgtttccgatatgattttctcgttgcaacagcgacaatataattcacgtcttttctgctgccgtttactgcaagttcgtacggattcagatgcagcatcgcctgtatctccccgtcttcttctaccacataaatctgattgtcttttactttttcttcgtaataatagtcaacaaagtctttgctgtcttctgaaaacacttcttcgtacagttttcttgtattcagcttttctcctgtttccagttttcttattttcattttgattttccttcccaacaagtttcttatctgtcctgcgctttcatacatccgccgcatccggcacatccgccttctgccggtccgactctgtaactgtaattagcaatcgtatccagacttgcaattgcctgagaagaaataccttctcccgttccggtaaatccaagtccttcctccgttgttgccttgatgttcacctgttcaacttcaatgtgcagtgcttctgccacattttttctcatctgttcaatgtgcggtgccatcttcgggcgctgtgcgatgatcgttgcatcgatattgccgatcacatataatttttcatcaattaatttccctacttcttccagaagttttatgctggacgctcccttgtacgccggatcggtatccggaaagtgctttccgatatctccaagcgccgccgccccaagaagtgcatccatgaccgcatgcaataatacatctgcatccgaatgaccaagaagtcccttttcataagggatctttactccgccaagtatcagatctcttccgtctactaatttatgtacatcatagcccatacctacacgcatatattattctccttcctttgtttctgcttcttctgtttctgtttctgcttcttctgtttctgcttcttctgtttctgcttcttctgactgttcttccttatcttttaattgtcccatcacactgtcatcttgatattccttttttataagctttgaaccatattttccaagccagaagattcctatgattacaaaaacaaccccggctcccgcataaaacacataattgtccggatgattcttcagcgaatccactaaaagttttcctcccagataagttatatacgccccggcaagcgaacgaatgatcaaactgcttcttggtaccatattcctattcctcctgtttctatacatcacatgtaatgtattatagacgatttcgcttttcttgtatacttcgatatataaaattaaacaacaaaaaagaaccggatacttccgactctcttgctgtgttacgatatatagaaatgcagcaaacctgccacaggcagcttgttctgcatacattggcacaaaaatagcgggaactggatttgaaccagcgacaccacgggtatgaaccgtgtgctctagccaactgagctatcccgccataatcagtagcgggaactggatttgaaccagcgacaccacgggtatgaaccgtgtgctctagccaactgagctatcccgccacaaccaattttagaaaatgtatgggaccaatagggctcgaacctatgaccctctgcttgtaaggcagatgctctcccagctgagctatgatcccatatattttgtcgtttctcttgaaccgacttcgttagtatagcattggttttttggaaagtcaactgtttttttgattttttcaaattttttctacaatttcttctataaccggaataaatcaaaatcgctgtgcgttaatctgattcaaaaaaagccccgcaaacacaaggcctgcggggcttttttgaaaatattatacgattccctgagctgtcatagcatctacaactttttcaaatcctgcaatgttagctccggcaacatagttaccttccattccgtaacgttttgcagcatcatccatattgtggcagatgtttaccatgatgtttttcagttttgcatctacttcatcaaatgtccagctcagtctctcactattctgtgacatctcaagtgcagatgtagcaacaccaccagcgtttgcagctttaccaggtgcaaagatcacaccattctcctgcagatactgtgttgcttctaatgtagtaggcatgttagcaccttcgcatacagctacgcatccattagcaactaactgttttgcatcttcaaggtgaagttcgttctgtgtagcacatggaagagcaaggtcaaccttaacagaccatacaccgcgtccttcatgatattctgaattaggacggtagttcttgtactctgtcagtcttgcacgttttacttccttgatttcttttaatgctgcaacgtcgattccgtccggatcatatacccatcctgtagaatcacttgctgttacaactttcgctccaagctgctgagctttctggattgcatagattgcaacgttaccagctccggaaactgcaactgtcattcccttgatgtcttttccgttgatctttaataattcttctgttaagtagagaagtccatatcctgtagcttctgttcttgctaaagatccgccgtagcttaatccttttcctgtcagaacaccttcatacaggcctctgattctcttgtactgaccgaacatgtaaccaatctctcttgcacctgttccgatgtctcctgcaggaacatctgtgtcagctccgatatatttgcaaagttctgtcataaagctctggcagaatgccattacttctctgtctgattttcccttaggatcgaagtcagaaccacctttacctccgccgatcggaagtcctgtcagtgagttcttgaagatctgctcaaatccaaggaatttgatgataccaaggtttacagatgggtgcagacgtaatcctcctttgtatggtccgattgcgctgttaaactgtacacggtatcctgtattaacctgaacctgtcctttatcgtctacccatggaacacggaatttgatctgtctttcaggttcaacaagtctttcaagaagagcgtcttttctgaatttctcctcgttagcctctacaacaactcttaatgactctaatacctcttttactgcctggtggaattctggctctgcaggattcttagctactactttctctagtacttcatcaacatatgacatagctttctacctcctaaataatatacgtatccttttcaaaggcatactttactataaaaaaacagatgacttacgccatctgtttttccctgacgcctttgtcctttactattgtaaagcaaacaagtgtatctggcaagatatttttacagttttttgttatttttgcaactttttacaaaacccttgcagattttgcaagggttttgtgctttttcttgtattttattcatttttttgaaacagaacgcactctgaattgcatttatcacaatacatagaattctgttcttctctctgtctgtttcattatctgaagtattttactccggattcaaagatcttcatatcctgttctccgtaaatgttcattgccacgcttctgtttcttctttctgagtgtgccatcttgccaagtacacgtccatccgggcttgtaataccttcgatcgcacagtaagaaccgttgacattccattcttcatccatcgtgatatttccttccggatcacagtactgtgttgcaacctgtccatttgcaaataatctgtccagccattctttatttgcaacaaatcttccttctccgtgagatgcagggtttgtatatacgccgccaagctctgcctctctaagccatggagatttattcgttaccacttttgtatagaccatcttggagatatggcgtccaatcgtattgtatgtaagagtcggtgaatccggtaactgtcctgtgatttttccacctggtaccagaccaagcttgatcagtgcctggaatccgttacagataccaagtgccagtccgtcacgctcattcagtaatttttctactgcttctttcatcttcgcattctggaatgctgttgcgaagaattttgctgatccgtctggttcatcaccagcactgaatccgccagggaacatgatgatctgtgactgtccgattgctttttcgaatacttctaccgaatcaacgatatcagatgcactcatatttctgaatacctttgtgatcacctttgctcctgctctttcaaatgctttcgcactgtcatactcacagtttgttcctggcattaccgggataaatactgttggctgcgcaatcttgtggctgcagatatagatatctgatgtatcatataatcctgtctccaccttctcgtcctgtccttccgctccggaattggtcgggaataccttttccagcgtctcttcccatgcagatactgcctcttctaatgcgatcttcacatctttatattcgattgccgcattatctgtcacttcaccgatcacggtataggtaattccaagttcagacaccttatctgcaggtacttctgcaatgatatctccgaatgccggtgcaaataaatctcttgcatctacattatgctcaatcttcacacccatgccgttaccgaaagccatcttgctgactgctgccgcgataccatgtctgtctaatgcataagctgctacgatcttgccgctgtggatatcttcggtaaacttaccatactgatccataacctttccgtatataggaatatcgtaattatccgtctcaatgcgaagccataccagtttatctccggctttcttaagttccggtgaaataatgtctttctcttttgcaatgtctactgcgaacgataccagtgtcggcggtacatcaatgtcttcaaacgttcctgacatactgtcttttccgccaatagaaggaagtccgtatccaagctgtgcactgtaagcaccaagaagtgccgcaaacggctggctccatctgtgtggatcttctgtcatacgacggaagtattcctggaatgtgaaacggatcttgctgtagtcaccgcctgctgctacgatctttgcgatagattctgtcactgcatagattgctccgtgatatggactccatgttgacagatatggatcgaatccgtaactcatcatacttacagtatcgcagtctcctgttaataccggaagttttgccaccattgcctgtgtctctgtcttctgatattttccaccatgcggcatgaatacagaagctgctccgatcgatccgtcgaacatctctaccagacctttctgtgagcatacattcaggtcttttaacataccaagccatttttctcttacatctttcacatcttctcttacaaggatactgtcttttctgttcggaatgtcaactgctaccgttgtctcctggtgtgctccgttggtgtcaaggaatgcacgtgaaagatttacaatctcttttcctctccatgaaagtaccagtcttggatcttctgttacaactgctacttttgttgcctccaggttctcttcggatgcatatttcatgaattcatctacatcttttggatctacaacaactgccatacgttcctgtgattcagagattgcgatctctgttccgtcaagaccggcatatttcttaggcactttatcaagatcgatctgaagtccgtctgcaagttctccgatagcaacggatactccgcctgcaccgaagtcgttacatttcttgatcagcttactgacttcttctcttctgaataatctctggatctttctttctgtaggtgcattacctttctgtacttctgctccacaggtctcgatagactcttctgtatgtactttggaagatccggttgctccaccgcatccgtcacgtccggtacgtccgccgagaaggataatgatatctcccggatccgaagtttctctgatgactgcacgtcttggtgctgccccgagtactgctccgatctccatacgttttgcaacataattcggatgatagatctcttttactgctccggttgccagtccgatctggttaccataagagctgtatccgtgtgctgcttctctaaccagtttcttctgtgggagctttccttttaatgtatcttttacagatacggttggatcagcggctcctgtaacacgcattgcctggtatacatatgtacgtcctgacagtgggtcacggatggctcctccgaggcaggtagcagctccaccgaatggctcgatctctgtcggatggttatgtgtctcgttcttaaagtttacaagccactcttcttccactccgtctacctcgatcggaacaacgatactgcatgcattgatctcatcagactcttcctgatcctgtaactttccttcacgttttaattttctcattgccatcagtgcaagatccatcaggcagacaaacttatcttctcttcctttgaaaatctcactgtggtcagcgatatactgtttataagttgcttccatcggctctctgtaatcaccatcgccgaacgaaacatctgtaagttctgtcgagaatgttgtatgacggcagtgatctgaccagtaggtatccagaacacggatctctgtcatagaaggatctctgtcttcttctgacgcaaaataattctggatatgctggaaatccttaaatgtcatggcaagtccgagagaatcgtataattctttcagtttgctttcttccatatctttaaatccgtcaaagatctttacatctgccggctcatcgaatacagtaaccagtgtctccggtttttcttcctgtgcttctctggaatctacagggttaatacaatgctctttgattgcttcgaattcttcatccgaaacagttccgtttccaccatggattacgtaagtagtcgcagtacggattaccggctgctcgtcttctttgataaactgaatacactgcacagcggaatctgctctttgatcaaactgtcccggaagaaattctacggaaaagatcttgcttctttcttctgcctgaaattcttctttatataatgtatctacaggtggttcagaaaagatgccgttacatgctttctcaaatgtctcatccgatacgttttccacatcgtaacggatcagtacacggacgctgtctacgtctttgattccaagatagcttcggatctcggtcttaagttcctttgcctgtacatcaaatcctgattttttctccacgtacactctttttacattgctcataagtaatcctccacaaatgaatttttacacattttctattgttagtataacacaacaatcattatttaatacaattaatatatctaaacacttttataactcacacttattaatcaacttttttctcttcctttttgcaattattttttccaaaaaacaatacaatccatatcagaagcagcactccaccaaacacttcactgatgcggatcaccatatccgaaaagaatccttccggcagcatccgtatcatataatccgtctccgggtcgaatacccacagattattggtaaaaaacagcttatgaaaaatcgtaaaacacgttgtaaaatctacacggaatgcaatccccagcagtacgcctatgaccagccagacactcagtgcgatcgaatatgttctgaaatacagtctcttccagtcttcttcccgttttctcagtactgccagtataactgcagccacagccagacagattactccgactttcattcctcccaggaacagattcctgacatcacgcatatgcagccggtctctttcattaaagaaatcctgctctcttccttccactgtcgtcacaaccgacagctcctcctctttcccgatcagataattcatcatatgttctgtcacatacatgacatggtctatgctcatatccagatcttccgtcacttcatagcgttgatattcttttttataaaacctgtaattactgtctccatatacggccagccatatactaaatatcagtgctgccatcactgcacacatcatggccgtaacagatatgatcgttgttagcttcttcaagtctttttcctcctgcttttcattattataacacttctatttataaatacggttgtaattttttttcatttcacttataatacagttaagattcattaggaggacttatcatggatattaactatgaattatataaagtattttactatgtagcttccaccttaagcttttcggaagcctccaagcaattgttcatctcacagtcggctgtcagccagtccatcaaggcactggagaagaagctggatcagaccttattcatccggagtaccaagaaagtccgtcttactaccgaaggcgagatccttctgcgccacatcgaaccggcgatcagcctgatcaagcgcggcgaaagccagctcctcgatgtcggcgcacgcggaggacagcttcatatcggagccagtgacacgatctgccggtattttctggtaccttatctggaacgtttccaccgggaatttcccggagcgcatatcaaagttaccaatgcgacatccattcgctgtgtagaactccttgagaccggacaggtggatctgatcgttgtcaattcaccgaatgcttatctcgggaatgttccgaatgtaaaaaaaatcaaagattttcaggatgtatttatcgcagacaaggcatttgaggaattaaaaggaaagaagctctctttcaaagaacttctgaactatccaatccttatgctggacagaaaaagtacaaccagtgaatatctgcacaatctgtttcttcagaaccagctggatctggttccggagattgaactcagcagtaatgatcttctcattgaccttgcccgcatcggacttggaattgcatttattccggatttctgcctttcccagacctccgattcggattcgcttttcattgtcgagacaaaagaagtacttccggaaagggagcttgtcatcgcatataacgaaaaagtcccgatatccaaagccgcgcaggaatttttatcttatttttaatacatctttcggatgcatgatggaaaataccataggagcatatgttcctcatggtatttttctttttaatgctgcttatttcgtatctgtctgttcttccgccttccagaattttgcaatcttttcttcaatattttcactgttacagatctggaaatcattccactccctcgggaacacctcctggcactgtctgtccataaaccggtcatccaacagtgtgatcacacctctgtcctgatcggtccggataactcttcctgcggactgtaacaccttattcatccccggatacaggtaagcataatcgaatccgttcagattcttccggtcgaaataatactttaaaagttcccgttccaggcacacttgcggaagtcctgtcccgatgatcattgccccgatcagtttatcttccgtcagatcaattccctctgaaaagacaccacccatcacacagaaaccgatcaggctgtgtgctctttcctgttcgaattttttcaggaattcttcccgttcctgctccgtcatatattgggactgtactacaacttcaatctgttcctgtggcaattccatgaatacttcccagactttttccagaaatcgataagacgggaaaaacacaatataattccctgttcttccttttatcacatgcatcacgtattctgcatacttccggtacatctccggtcctcgcctggtatacttcgtgctgacatcatttcccagaagcaataatcttttgcctggttcaaatggagattccgcatagattgcatagtcttcctttgttgtagataacagttttttataataattgatcggaagaaatgttgccgaaaataatatcgtactatttgctttccccatatattcctgcagacatcctgccggattgacacagaacagatgcaggtaaaactttccttcttcactaagttctgaatagatcagataattttcatcctgccggtcatgaatatatatgaaattacggataccaaagtaaaactccagcacctctttccgtatcacttcatctttacagtcttctataaactcttccagcttcgtcatcaaagacagaagtttaatatacacatgtgacacactgttcagtatctggcagccgtcacattctcttttcaattccagaagctgcttattgcagctctccaacgccgagacaagtttcggttccccgtattttaccagctttttgatcttcagaaaatcctccttgcaaatactgctgctgtacattgtcctgccgcgttctaccaaattgtgtgcctcatcgatcaggaacaggtattctcctttgacgccgtctccgaaaaagcgtttcagatgtgcatttggatcaaaaacataattataatcacatataacagcgtctacccactgcgatacatccagtgccatttcaaatggacatacattccattttcttgcctgttcttccaatacttcccgactcatctcgtctgtcgatgtgagcagttcataaacggcatcatttacacggtcaaaatgcccttttgcatatggacacacatccggattacagatggtttcttcacagaaacagattttttcttttgccgtcaatgtaatgaccttcatcttcagatcctgttctctcagaatcgcgaatgcctgacttgccaccgttctggtaatcgtcctggccgtcagataaaaaatcttttctcccagttcttccccgacagctttcaccgccggaaatacggccgccatcgtcttgccgactccggtaggtgcctggatgaataatttcttttttcttaaaatggtccgatatacggactcaaccagtttcttctgtccatctctatattcgaatggaaattctacggttttaatggaagcatttctctttgctctccatgtcatctggtatcttgcccatttttcatattcagataccagcttttcgaaccatttcttaagttctgcccgggtatatgtctcgcggaatctgcggatctcttcggtatccagattacaatacgtcatctgcactccgatctcttccagattattttgttctgcataaatatatgcatagcattttgcctgtgccagatgcaaaagctgtggctcttccagacgtttcagatctttaaatacacctttgatctcgtcgaccaccacacgcttcggaagttctatgattccgtccgctcttccttctacactcaggataaatccatcacatgggatctgatatcttaacggaacttctgcacggtactctgccccctgctgtctctggattttccggtgtatgcggctgccctgctgcatagcatccttatctgcccctccggtccggttgtcaatatctccatgtcttaatataaattccaccagattccgcaccgaaatgcggatacacggctgttccagattcatgatctgctttcccccaatcgttcttcatacatcgatcgaatcgctcccgtcatccctgcgatcacatcgatcaccgtcatgatatctccgctccgattcttctggtaagcgtggtagcttccctggatacaatagctgagcatcacattcattgctgtatcttctttcaattccgggtatttttcaaagatcatctgcttgatgctccgctcgatactatccgcaaaatgattcgcctgactgccggaaaataaaatcgccgtcagggaattctgcgatacataagccatcagaagttcccgtgcaaactctgccggatgctccagcagatattccggatgctggatactgttcgcaatcgactgtactacttcttcttccatcgcatctgacaaatcgtagatatctttataatgcgcataaaaggtagacttattgattcttgcgctttcacatagttcttttactgttatcttttccaaaggtttcctggaacgcagttcgataaatgcgttcttgattccccgctctgttttctcaattctaagatccatcttacctcccatttcccaacactttctcatattcgtcggttatccatcctttcgtcggttttgttggtggatacctcctcgcatttttcttataatatgattataaatcaaaaaagcaactactgtccattatcttttcgacagttaatcttttacgttgcattttcacggaggttaatatggatttttacggattttacacaggaaaaatattcgacgcttatgaatttctcggcgcacacccggacaaagacggaaccacattccgtacctttgcacctgccgcatcacgcattacagtcattggggaatttaacgactggcaggaatgggaactgaacaaaacttatgacggcaatttttgggaatgctatgccaggggagcaaaaccgggtatgatgtacaaataccgcatttacagacaggacggaagctgcgtggagcactgcgatccttatggcttcggcatggaactgcgcccggcctttgcttccatcatccgcgatctgtcccactataaattcaaagacagcaaatggatgcagaagcgttcggtatgcaaggacaagccgctgaacatctatgaactgcatttcggatcatttaaaaagccttctgaaaaagcagacgactggtatacttatgtggaaatgatcgatatcctgattccttatctgaaagaaaatgattacaattatattgagattatgccgctcagcgaacatccatgtgatgaatcctggggatatcagaacaccggattcttcagtccgaccgcccgctacggaactgccgaagaactgatgaaattcattgatgcctgccacaagaacgacatcggtgtgatcatggatttcgtgccggtacattttgccgttgatcactatgcactggccgattatgacggaacttcactttatgaatatccacatcaggatgttggtgtcagcgaatggggaagctgcaacttcatgcattccagaggcgaggttcgaagcttcctgcagtctgctgcgaactactggttaagcgtatatcatgtggacggaatccgtatggatgcaatcagccgtatcatttactggcagggtgaaccggcaagaggtgtcaacaataatgcagtagactttattcgtgaaatgaaccgcggattaaaaacactgcacccgacagttatgctctctgccgaggattctacttctttcgaaggcgtaacaaaacctgctgatcagggcggacttggattcgattacaaatgggatatgggctggatgaacgatacacttgactacttccgcaccgcaccggaatacagaagccgcgattatcacaagcttacgttctccatgatgtactattataacgatgatttccttcttccgctttcacatgacgaggtggttcacggaaaggcaaccatcgcccagaaaatgcatggagaatacgaagagaaattcccacaggcacgtgccttctatatgtacatgtatgcacatcctgggaagaaattaaacttcatggggaatgagattggacagctccgtgaatgggatgaaaaacgtgaacaggactgggatatcctgaagtatccaattcacgatgcattccatcacttcatgcagaaactgaatcatctgtatatgacaactccggctctttccgcaaaagactatgaaaacgccggcttccattggctggactgtcatcaggaagaacgctgtatctacgcttttgaaagaacggatggcaaagaacgtattgccgctgtctttaatttctcggatgagaatcaggaaggatatgagcttccaataacggatgcaaaggaactggaagtgattctggctagtgatgatgtaatatttggaggaagtaagaagtatacgaagaagaaagtgaaggttacggatgggaaagctgtgctggatctttcggcgtattcagcagtgtattttgggatttaatttattaacggggaagcgacctctcagtccttgaaggaaacaatagataaggcttcttgttcaggttccataccataagaaacactaagagagtcagaatcacctaaaatcaaaggaactacgctcaaactcggcgttcacctcaaacacgttcgcttcgttcctttaacggtgcttctgactctctaattgtttctaacggcattccacattcacaataatccttatctattgtttccttcaagtcgtgactggcagcggatgttaataaataaaatgcccgaaagtgcaggtccgggtagtcatgccttctaaattaaatcccaaatttattttttcttcctcggcaccacatgcactgcgcctccttcggaatctgcctgcttttcatgcccattccccattttaagcattaaaaaagcaggcaaaaaatactttcttctcaaaagtgttttttgtctgccgctgtccttttacctgaaagattacttctatggtatcttctaaagtttattcactgcttccgcaagataatcattgcttacttctgcaaagttctcattctccactgcctctgcaagacttgcatcgatcggcatcttaccgatgaccggaacgccgagttcttctgccacttcgtcgatgtggctctcgccgaatacggagatcttacgtccgcagtccggacattccagataactgtagttctccacgattccgagtaccgggatatccatctgtcctgccatgttataagctttctttacgatcatgcgtaccagatcctgcggagaagttacgatcacgatgccttctaccggaagggactggaatacggtaagcggtacatcaccggttcccggcggcatgtctacgaagagataatccaattctccccatgcaacatctgtccagaactgtgtgacaacacctgagatgacaggacctctccagataaccggatcatcttcttccggaagtaaaaggttgatggacatgatcttcgttccatcctttgcctcacatgggaaaatattttctccatccccttttgctttttcatggattccatacatcttcggaatggatggacctgtgatatctgcgtccatgatacctacagaaaatccctgttctctcatcagccttgcaagcgatgcggtaaccatagattttccaacaccgccttttccgctgacaactgcgatcacatgattgatgtgtgattttttattttccggtttgatcagactctgcggtttgcttccgcattcacctgcatgggaacagcctgcacaatcggacgggctgcagcctgttttttgttcttctgccatttgtcttactcctctacagccgcaataagttcaacttcacacagaactccctttggaagtgtctttactgcaacacagcttcttgccggttttgatgtaaagtattttccatatacttcgttgaatgctgcaaagtcactcatatctgcaaggaagcatgttgtctttaatacgttgtcaaatgatgttccagcttcttttaagacctctcctaagttcttacatacctgctctgtctgtgcttcaattgtagttgcttctacatcattcacttccggattgattgcgatctgtcctgctgtatacagtactccgttgtgtacatatccctgtgagtatggtccaagtgcctttggtgctttttctgttgctacgattttcataatgttatttctcctttgctacttcatataatttctgtgcgatacacacatcaaataatcccattccaaccgatttgaaatatgttgtctgaccttctttgatctctttttcccccgatacgagatattcatgcatcagttttatgcggtcttttgtaagttttccacttgccaagggctggcttagatctccgctttcctcacatgcgtatggcagttcaatgtatacattgtccaccagatccagtactgcatccgggatttccctcatctccggcatataagagccgattgcaatgatgcattttcctctcagaagttctttgtcatctggaagaacaggtgtggtagaaggagttgttgtacagatgatatcactgtttcgtacaagctcttccactgctttacattgtactacctttacgtcttccttatcaatagcttttttcagtctttccagataatctgtcagatcacggtcactgtggttgaacacatatacggtatggatatctcttgccgcacatgcatacacagcctgatggaatccctgcattcctgctccgatgattccaaccgtatggcagtcctttcttgacagatggcggattcccacaccaccgacagctccggttctccatgcggttaccgactgcccgtccataacagcaagcggcgcgcctgtcgtataatcattcagtaacacgataccatctatcgacggcaatcccagtttagaattctccgggaagatcgacaggatctttgtccctatgatatcctttgtgtaacatggcatatacatgagctgcttattttcatgttctaccgttggtcttggcggcatatagaactcacctgatccatagattcggtatgcctcttcgatctgatccatcatctgatccggatcgaccatttcttcgatctgctccttgcttaatacgatcattttacatttcctccagttctttttgttcccttgtgacatctctcagccacttgtatgtcaaataccgctttaaagtaatcggtactttgatcagttcatcactcatcagtataacatagacgaccggcacactggcatgcaaaataaatgccgccactgccccgagtaaaatggagaatccccacatcgtcgatacatccatgatcaatccgaatttcgtatccccgcctgcacggaatacccccactaccattgtggtattaaatgcctgtgccacagtaaaatacgacataacgaagaacatgaaacttaagtaattctttgccggtccggtcagtgccagattcgcattggcgattggtgccgagatcagtatcagaacaccacccaggattccaagaatcagacttaaccacacgaaacgttttccgtatgcctttgccagttccatcttgccttccccgatcgtcttgccgagatagatcgccgttgcatgggaaatcccgaatgttacgactgttgcaagctgtcttgccacctgcgcaaccgagttagctgccactgctgcgcttccaagatgcccgatcaccgccgtattcgccgacgttcccagtccccacatcagttcatttaataccaccggcatagaataaactgcgaaatcttttaacagaaccttatcgatcttcaccatatctttaagccggatccttactactttatttcggaagatggcataaacgagaaccatcactgtctcggctgctctggcgcacaatgtaccgattgccgcacctctgactcccattaccggaaatccgagaagcccgaagatcaggactgcatttatcacaatattcataagcagtgagatcaggtaaatgaacgtggctaccatgacccgttcaatactacgcataatatttaagtaaacctgtgtcactgccataaacacataggaaaatcctacgattcttaaatactttactccttctgcaataacttccggatcagaggtatagatccgcatcagtgtctccggcatgccaagggctgctcctgcgaatactaccgcaacgatgagtccggcacttaatcccatacccaggactttctctatcgttctggtgtctttcttcccccagtactgcgccgtcagaaccgttgctccggaggtcactccgtaaaagatcagtgtcatgatgtattggatctgtcctgcaagggatgccccggataacactttctctccaacctttccaagcatgatcacgtccgtcgccgtaactccgacattgatcagattctggattgcgatcgggatgaccagagcgaatacattccggtagaattgcttccagttgattgtttttgtatatttacttttttcttccatttattttttctctgctcctatttattcttatcacattttctgcctctctgcagataatacaccgcaagctgtgtccgatctcttaattccagtttctcgagcacattgctgatataattccggaccgttccttcgcttaagcagactttctccgatatctctttgttactgagtccctcagcaaccagtgctgtgatctccagttcccgttctccgattccgtaactgttccagtcaaatgtctgctctttttctttctgctctttctgaagcagtcccggaattcgggacatgatctcggttccgaatacggtctgattcatctgcaccgcctgcaatgccggaaggatactgccataatcctgttttatcagatatcctttcacaccatattttaatgcttttacgatgtactcatcatcagaaaacgtggtaagcaaaagaatctttgcatccgtatgcattttcaaaatctgctctgcagcgtccaggccgttcatgtccttcatccggatatccatcagaagcacatccggaagcagttcatcatataaccggatggcatcttttccatcctgtcctgtgccggttacttctacttctcctcctgcttccaggattgtctttaacgcactggataccaggatatcgtcatctacaattactatcttcatatttttccctcatttttaggaaccgtaataaatatacggaagccattttctttctggatctgcatggttccgccaagcatgcggacacgttttttcatattctcgatcccgattccgctgctttctgtattttctgtttttcgaacgtttccggtctttccggcactttcctgctctgtatattcttccccgtctccatctgactggatccgcttatctgacgttccattatcttctatgatcagctgatatagtcctggatgttctcttgccaaaatcttcacctcatttgcattgctgtggcgcatcacgttattcagtgcctctttcgtaatggctataaagctgtatttgatctcttttggaatatcatatcccatatcataagcaagctgtaccggacaaaaacggaattcttctgccagcgattccatcacttcttttaaatttaccgactcatcatgcagatcgtgcacgctctgtcttacattcgtcatggcttcgttcagcgtctgatccagttgctccatcgggactttcagattctcagcctgattaacagtctttaacgctcccaccatcaggatggatcgcgacagcatatgtcccacattgtcatggatctctctggcgatacgattccgttctttcagtgtggccagatatacttctgtgtcctgcttttccagcagatcctgattcttcttttccagcatcagtgtcagttctctgctgtcatctctggcccttttatattcctgctccaattcatttagcctcctggtccgtccatataacagaactgctgctgccagcccggcaacaataagcatctctttttccagcccgtaatattcccggaacgccggcgcctcacaggccacgattataccgccagcccctatataaaccggagaataaaagcatagcatattatataaaactaccggaagaaacatccacatttctttaaaaacaattccggctgccacgaaagcaatcgtcataatgtaatgcagatacttttcttcccctaccagattcacacaggtatagatacacgcaaacagaatagtgataaccgccggcatccctgtttccgctgttaccagaagtcctgctccgtaaaggaacaaaaatccttcatctgttatctttctcattcttttctcctatattacatttgtcacattcaattcatgacctgtgacactaccattataatcagccatccgctatactacaagtaacaaatcatcaaggagggactcttatgcttgtacatatagaaaatctggtaaaacgttacggtgatctgttagcgcttgaccacctgtcactcgacatcgaagaaggtgagatcttcggactgctcggaccaaacggttccggtaaaaccaccgccatcaactgcttgctcgcactgttaaaatacgacaaaggaacgatcacgatctttggaaaggatatgaagccggacagctacgatatcaagcagaatatcggtgttgtcatgcagaacgttgccgtcttcgagcagatgtccgtctatgaaaacatcgattatttctgcggactctatatcaaagacaaacaaaaacgaaaagaactcgtggaagaggccatcgcatttaccggtctgtccgatttccgtaagatgcgtccgaagaaactctccggcggacttctacgaagactgaatatcgcatgcggcattgtccataagcccagactcatcatcatggatgaaccgaccgttgctgtagatcctcagagccgcaacaagattctggaaggaatcgtagagctcaaccgccagggatcaactattatctacacttcccactacatggaagaggtcgaacagatttgtacccgtatcgcgatcattgatcatggccgtgtacttgcttccggcacaaccgaagaactaaaaaaaatgatcaagaccggtgagacgatcacgatcgaagcggttgcgttaacgaaaaacaacctggcagatatccgctccctttcacatgtatttgacttatcataccaagatcagacaatgatcctacgctgcagcggtgcaaaacacaatctgatccgggtactgaattacctgcaggaacaggacattccattcggacgcgtcttctccgagcttccgactctcaatgatgtcttccttgagatcacaggaaaagaactcagggattaaaggagggacactttatgttacatttattaaaatatcaattcttacagacaatacgttcccgctctatcatgttctgggctctcgcatttccgctcatccttggaaccctgttctatgtgtcctttggaaataccggtcttgcaggaaccggagagactgactgggaaccggttcctgttgccatcgtcatagtagacagcagttccgcaaatgcagcatctttcctgacatttctgaatgaaacggatcaggacatgatcgatatccattcttacaagacagaaaaagctgcaaaaaaagcgctccggcgggaggaaatatccggcatctattacgtgaagccggttccttcccttaccattgcttccaatggcattaaccagagcattctgtcttcccttctggacagctatgaaaagaatgctgacatgatcctggatattgccacacagcatccggaaaagctttcggacgccctttcatccctgaacgactaccagacactggtgaaagaaaagtccttaggcggacattccttagatccgacactgacttattttctcgcactgatcgcatttgcctgcttaagcggagtctacttaagcatccattccacggttcagcttcaggcgaacttaagtgcactcggagaacggcgcagcatcacaccgacccacaaacttttcctgattctcggcgatctgctggtactggaaagtattcatttcgtcaacatcctgatcctggagctttaccttacccaggtacttcatatcagccttgggcatgacattccgaaacttcttctcattacatttatgggaaccctgatcggtatctgtctcggaattctgatcggatgcgtcggcaaactgtcctacagtgtcaaatccggaatcggtgtcctcgttacactgttaccgagtttccttgcaggcctgatgttcggtggaatgaaaaatgtgatcgaacagcattgcccggtcatcaaccggatcaatcctgccagtgtcttaagtgatgcattctactgcctcagtgtctatgatgatgctgtccgctaccgtaggtgtatcctgattcttgtaatcatgtgcctgctttgcatcagcttctcatttcttatgataaggagggaacgttatgacagtatttaaaggatttttaatcataaccaaacgcaatctcctgatggtatttatgtatctggcaatcttccttacgattggaatccttgcctccggcagcgacagcaatacttccggcaccaggttccatgcccaagcactcacggtaggtgtggtagatcatgacggaggcgtgctttccaaaggactttccacatatctatcacagtatcataccgtcaggcaaatgccggatgacactgcgaaactccaggacgcactctttaaccggaatgtctcttatatcgtgaccattccgaaagattttaaagtctcctgtctccgtaagcatcaggcattaccggtatccaagatccccggaagcacagacgggtactacgtcgatcaacagatcaacacctatctaaatcaggcacgtgtcctgacagacagtgggtattccgataaagaggcagctacatatattctgaaacatgcagacagttcttctcatgttacgatgttaaaatctgcttcttccgaaaagacgccgggttatggttacatgtatcagtatctgccatatgtgttaatctccatactgtgttatgtaatgggactgatcatgatcgcattccatcagccggatctgcaaaagcgaatcctttgctcggctgtgtccatcagaagccagaacctgcagcttgcactgggatatctggcagtcggatgctccgtctggatgcttacaacatggatccctgctttcttcttttaccggaaagcatttttccagtcgccaaagatgccatattatatgctcaacagcctgaccctgcttctggtcggccttgcgctttccttccttcttggtacatttatcaccaaagaagatatcctgaccgccctcgtaaatgttgtcacacttggcatgagcttcctgtgcggcgtattcgttccacttgatatcatgggaaaaggcgtgaaaactgtggctcattttcttccggtctactggtatgagatcagtaacaatctgctgaacaactctgctgtcctcactcaggcacagagacaactcttataccgcaactatggaatccagttactttttgccgctgcgatcttctgtatcgcactggtagtcagtaaaagagcaaggcagacagcataatgctgcctgccctgctctttttttctatctctattttatctttttcttctgtatccattccacaatcttatagcccagatatccggaaagacttccgaatatcacgccgccgataatatcagtcggataatgcacatacaggtacaatcttgataatgcgatcagaaccgcaagcacaagagccgctttccacatcttcttctctccggcaagatacaatgccgtaaccgaagcaaatgaagccgccgtgtgtcccgacgggaaagagtaatcccgcggctttgcgaccagtaattgtactgctgtattgacatcgaatggtctggttcttgccaccagattctttatgaacacattgcagagcagcacatccaccagcaatgccgccatcatgatcactcctgtctttcgtgtctttggaatgatcagtaataataccatcagaatgatccatatgattcccgcatctccaagtctggtaatgagcggaacaaccacatctcctattggcgttcttaaattctggatcatatcaagaatatgtatctccatctatcttatcctctcaaatttatttttcttattatttatattttttatattttccctctatatttttccatctgtcttttctgtcctgagtaccggcatccggaatgtctggatcaaaagcgggattaccataatgaaccacacgatcggttcacagatgatcacacccgtatatccaagccacggaaccagagtggccgcgatcacgatcttccctgccatctcaaggccgctggagatcagtggtgtaatatgatcccctaatccctgcatcgcatttcttaaaatacagatcaaggtagtcacaatataaaacagcgtatcaaacttcagataatttgttgcatttaagattactgtcttattatgacttccggttaccagatataccagccatcctccgatcatataacttgcaatgatcgtaagtcctgaccagatcgcagtgtagacaatcgccagccagatgcctctcttcacacggtcgatcttccctgctcccatgttctgcccacagtaagttgccatcgtctgtccgaatacactgaacatgatcatgaatatctccgagatctttctcgccgctgtatgggcaatgataatgtcttttccaagcttattgatcgccgtctgtaatgtcaaagtaccgatattaaccagagaactcataaatcccatcgacattccggcacttatcatctcttttaccatgattggacttggatctttaaaatcctctttctgaagccttaatatctcatattttctaatcatatagatccagcagatcacaaatgcaatgatctgtgccagtacagttgcaattgctgctccttttacgccagtcttcaataccacaacgaagaacagatcccccacgatattcaatgctacagatatcgccagaataatcaatggtgttactgcatctccgattgcacgaagcgtcgccgcgcaggcatcatataaaaatgttgcaagcagtcctgctatgatgatcgcgatatatcctttcgccaccggaaccagatgctttggcacatttaagaaatgtaagatcggtttcaaaaatagcagtcctgctatcgtaaataaaatggatattccagtcccgatcacaagcgacattgcaaaggactttttcatatctgcgatgttcttcgcaccaaatttctgtgcggtaataatcgcaaatccgttggataatcccagtaaaaatccgatgatcagaccgctcagtgtgctggtcgcacctactgctgccagtgcatcttctcccagaaacgagccgacaatcctggtatctaccagactgtaggtcagctgtaataagtttcctaaaaatatcggtaatgcgaaacttagtatcagtgccgagggctttcccttcgttaaatctttcattctttctcaatgtccttcctttttcagtatgattttctctttacaagaaaacatgcaccgctcattatagatcatacttccgaagagagcaatctctgaaagaattttttccgctttctttctgtcaccggacttccgctgcggataacctgtgaacggattccgatgttggtcagttcctgctgaagcttaacggctttctccgcatccataccatcccggatcagaaatggtgccatagacaggtcttccttcgtttcaaaattatattttttcgcaagctgtaagaagccatttctctgaccataatattctacaattctcccaagtacaatgacctgtctggatggatagccgcacacctcacatgtttcttccagtggtgtgatctcgtattctactttataaaaatcaaacgcctctttaaaatattccatgccttcttcgtccagattatcaaacagtgtggctggaaggttcgatacgatgcggttagccatcactttatcgaggcctgtcagaagctgcagataagcggatatcttctggtcttttccgctgcattttaataaacgtattttatatgttctcatgtaatttttatcctctttctgttttcagatatttttcggttacgctctgttctgacgccataatatcctctggcgtgcctgctgctacaatcgttcccccggcatctccacctcccgggcccatatcaatcatgtaatctgcattcttcatcacatccagatcacgctcgatcactatgacaggtgctacatttcgctgtagttacctatcatgtccggctctgcctgaacctccatgaaagttgttctttcgggtgggtggggtattgcttttggatgtatgtgaatatttcttgttggttcatggggattccttctttttgtcaataaaataatctccccattggacactttatattcgctctttcctgtttgcaaggatattatttttcaatctcttttacattttttattcgtgcaagactcgttttccaaatttcgccactataataaacttttatattatctcacggcgatataactgaataatcatatttttctggccaataacagattatttcttcttgtatatctgtttctagtatttaaaactgctcctttttttcgataacgactcctttgcattttgcgccctccggcggtcgcaaatgcgttttaaaacggccgctctgcggagcataacggccgtcagtttttagttaattaaccactattatcgagtgttgatcttgatagtatagtgttttgtggctcgtttcataatagaattagctgacacttcatcgttgagaatcattgccttccaactagccggatcacgccgcgaacatacaatggtactttttctctgttcgttacatttctcaaattctcctgttatctattccactgccaagtctgcctcttagtatcgagtggcttaaactgcggtcgtttctgacaacaatcccagtgccacaacacatgacatctaatccgcagcctaaaccctactgcattttttcggtcatacactttttctccggtcagactaaaaagtagatatgtttccatacaagaaaaccgagctttccgcaaggcttctctgatgatgctgacctcgcaaaaagcccggaaacacgccacttttcagcctttatttatctttccttgacagcaaacagaccgtctcaacgatactttcattgtcccaacaaagttcctgtgtttccctgcctccaaaatacactggaaaacggaactttatgtgcttcaggaatctgccatctggctgcttctgctcgtaaatgtccacctgttccacaaagctgttaagaaattctttcttctccagattggtgaacttatcatatagtttatcaaaatataaaagaaattgatagacgttttcttctgatattttctcttgctgaatattcaacaggcggttcttgacttcttctatactgttctccacgccttcaatctcatcatacaaacggtataaccttgtctccatatcctgatatttcttctcataaaatttatccatgatatccagactgtccatctgctgtccaagtcttgcttttgctccggtcaactgcctgtgctacttttccaatccttcaatctcttttctatttcttctgtatctattcttgaaccgattttattcagaattgcttcttcaaatttaggattcttcaccagtttccgaataacttcttctactgcattgttaatcttatcctcgctccattgtttgcgatatccacatttacgaccgtctaccaggcgacgatgtttgcaggcataatagaaataatccttatataaggttccgtctttctttttctttcggttcacgttcccatacataccgcttccacataacgaacacctcaatattccagataagatatgttcatgatcaagactatgtgtcttttcatatttcacacctgttttttctcgtttttgatgagcaagctcccagtctgtttctgagatgattccttcatggataccaccgtgcagcatataattttcctgctttacaatgcgatattcatttcttgttccagaaactttctcgttcttccttcgtccataagccaactttccgcagtataccggattatccagaacgccttttataaaggaagaagcaaatgcgtccagtgtattattctgtcgttttttctttttatatccatgctgattcagccatgcagcaatcgcagagattcccatattggtatgaataaatttatcatagatcagacgaataatttccgcttcatcctctgcaatctgcaattctccatttaccaattcatagccatatggagcaaatccaccgttccattttccttccctagctttctgtttatgtccatccattgtctgaacaaggatattctcccgttcgatctctgccaccgcagacaggacagaaatcatcagctttccactatcttttgagctgtcaatcccatcttcaacacagatcagattcactccaaaatcctgcatcctctgcaaagaatttaaaacatctgccgcattacgaccgaatctggaaagcttgaacaccagtacaaactgtacctcatctgttccattctcaatattatctaatattctctgaaattccggtctgccctctacgctttttccagacttaccttcatcggaatactcatttacgatttccatgttctgaaattccgcatatctcttgagttttttttctgagcatctagactgtagccatatacctgcatggttgtagatactctggtatatatatcgcatttaatctttttattcactttttctcccctcctcagaacatcccaaagcaatttccaacaattcagttgcaacttgtgaatttctgatacgcattaagttatcccaaacatcagcttttccaagtagattcatcccaccatgccatacacctattacatctgatccatcttcttttgtgcctaacaaatgagcaattattttttttacatccagacttatccatttggtgttttcacattcatcacaaaataccttctctttacgttgcttagggcaaagccggtcattccaacgatttgcacactgtggaaaatagcccccgttctttccccgtctggcatatacatcttctcttccccaaaacatcgaaaagaaacgtattgccattttctctgtaatatatggcggatttacaatacgattcccttgatccaggtcatattcttctgcactttctattttttcttcaaaaggattcacctcttcataggaaatgcctgctttcttcaatttatcttttaatatcttgttctcatattcaagcaacctaaccatctttctcaatgaatccgcatcatatgcttctatgttcaaaccttccacctacaattcttattatctcgtaacataactcctgttcaatgtcccaacttatttttagtacttgttccaactattttcaatacctatttttcttattgacgcacttctctgtcaatcgtataattatacaaaaaatcctctaagacaataggtatttcactatttcttagaggatatttctttactttaaatggtatttggtaatacttttccaggtttccgggaagcccattttattcaataattcaacttcacttatatgctctacttctctgtttactcggtcaatctcttttataagctttcttttaaattccagaaaatcttttccaggtaatagatatctaaaagcaatcaccacagcaaacaaatcttgttttcctttttcgtactgattaccgctctgtggtaatgaaagttttttatgaagcggtgtatccgcaatagcatctactgttctgtatgtaaacagtcgttccccatgggcacatacattcctatacttagtgagaacagatagaaactgctccatctgatgttgattcaaaggttcaaagttttttgatacttttgattttaaggactgcggaaacactcggaacatttttgataagtttccaaacgtaagtacatttgccaaaacccataatggaatttcaccatatgtcttgcggtaatagttgatatatgtataatctgtggtcgttgttgcccgtttcaaggtcgctatcaactttacgattgttgcatgatttctttttgtattattataattattagcatccaggtactgcttctgctctgctccatacatttcagtaaaatagtatgacatcaaagaacgcatctgtcgctcaatctgcagtaaatatttaaagaacaactctctaagctctgcatcaaacttatacagactgactatttcttcaaaacttgttcctgctttatattttttgtgtttgatattctaaaaagaggtttatatcctcccataagaggaaaatatcctatttgacgtaacatctcttccgcatattctctgtcttttatttttattcccttttcatcactgatccaggaaacctggtcactaaaagaagagaattttttcgatgtctgcatctcatttctcctaaaaacaaaagagggagatacccgcaggctctcccccgcctgtaggcttctcaagtttctacagaacgatcactgagcttagtatacgtcattttaaatgtcctgtcaatacgccaaaacattctctgtcatatcagctcaaaattattctatgctatttttctccaaattatcattcttttttatcagcttttaaaatttatttgatttaaaaatacatgaaaaaagcgacagtctgatttacattttgtatttcaggaaactgccgcttctttttcttccttattctgtttttcttcctccaactcccggaggacttcttcgccgtacttatcaatcatccgtaccagaaaatcaatgcaccgctcaaattcaatattctgttgcataagctcctcccgttattgtttgttctgagcttattttacagaacctgcctgaaaaccacattgaatagaaacccgaaagaggaatctccgaattgcaaaaattatccggcatcatcaaggaataccattccgatcactgtctggattatgccaaagtacaggaaacccttgcaaccatttatctgatgaccgccaatctttcacacgccaaaacacattttaaaaaagctttcaaaatatatgaaaagatctgggctgatgagcctgaaatgattgaagcaaaatatcgggagattcaggagttatatccacagattggattttccattgaaaaaactctatccggtcttttaacaaaataagcataatttacggcgtgcaacttgcccgccgttatattcaactattcgtcaaataaatatacgcatcttccaaagtgatatcattatccgggacacacttctcatttggctttcctttgcttaatattttcatatgaattccattttctacatactgcttagatgaaatagaataattggcttctagcaaacgggcttcttctgcattttgtaccgtacaattccaaacacagccctttgcattttccagcaatccactcacgcttccggaatataaaaaattcccttttttcataatggcaagctgtgtacaggttgctgctaaatcttctactacatgagtggaaaacagcacagttctatcctttgaaaaatcaaccaaaagattgcggatcctgattctttcttccggatctaacccagttgttggttcatcaataatcaaaaaatccggattattaagaagtgcctgtatgagtccgacacgtctcttcataccaccagataattgccgcatttttttattctgatgctctgtaagagaagtcttttccagataataagtaattctttgttcgaggtcatttctggatactcctgacagtccccccatatatacaagacattctttcaccgtaagattcggatataagtcgatttcctgtggaagataaccaatctttttctgtattttctcataatttccctcgttatacagaattccatcaaggaaaaccattccttccgtttgttttaaaacagttgtaagaaccctcatcaaagtggtttttccagcaccattctcacccaaaagtccgtaaattcccttaggtatttcaagagatgccttatttactgcaactacaccatttttaaatctaactgttaaatcatttattctaatactcataatctatcctcttttctttaaagccattggtaatactgcaaataaaaacagccccgctataaaagacacaagcgttccataaatccaactctcggacattaattgagtaggttcacaaaagctgaaagaaaacaatcccagatttccgaaaaatgaacttcccgcttttgatataagtccaatgacaattccaaataaacatcctatacctgcccacatatttccaagcaatgtacacaaaatcacagaacatatactccaaagccagatggttccgaacattgcaatggaaaataaaaggaatatctgagtgcccgaaacgccttcgttaacactgcccggtttttgccagaaaaacaaaacatatccaacacaagaaagtattaataaatataatatttgaacgcccactctctgcgatattacttttaactgctttttttgatcatacaaatgaaatacatcggcacgcttactttttacttccatcaaatatgtgtcactacaaaaaataattgttaaaaatgctattggagactgaatcgctgaaccgatttcttcatagtatactatcggatgaatagcacacaatatcagtataaatgcacatgaataaaaaatcttatataacgacaggcagtttttgagttccgttttcaatgaaccctcctccttttccagattgtaacagaaatacatactaatataacagatgagatcacaagcataatctgatttatatttgacattttggctgcatgtgtttcaaaaaacctgccagggaatcgcaccataatagagaacggtctcatataataaatatcattcttcatggtcagcatatttgaatatataatgtgtaaaaacaagattggtgctgccggaagcggatttttaaatattactgctgtaattgtatagacacaacatatcatcaaaagattcggaacaatatagatcagagaattcacgcaaaaatcaattggtgttactggaaagcccgattctaaagccgttttcaaacacagcataaagaatataacattcaaaatcactaatactcccagcatactaatgaatccgcttattactttcccacatatatattggattgccgtaacaggctttgtatgtaataattcataggtactttttcgtgtatcctgaataaataaaaatgatagcaagactgttgcaaaaaaggccatatgcaatcctgcaaaatccgtgaactttttggcaaagtaccaggaaaaagaatgttcggataatttccgctcgatataatgattgatttcttctgctgtccccttatgaatttcaaggtcctcataagcatatattgcattataatagccatattgggattccaaaaactcagaagcagtctttacatccatattctgaatttctttcattacgtgatctgcttcctgcctgctaaatccaaaaccatttttggaggtgtccattaacgtctctttgatcgtatcttcccactcccttcttctttctttatcatcagatgtgggaatgtacccatccatgacatcagcatcttccaatgctacgtcattttgtgtgatctgttcattctgtttgatatagtgaatttgcaaatacgatgacagacattgatacatactggcaactataataatcaagccaatccacaaaacagggttctttaaataatcaagtatacttctttttatgattgttttcattgtatctcttcctttctttatttctttaacaacatcatacaaatcaattctcaataaattcacaacaaaaaaggctaaaaccactttatttgtgatttcagccttataaagtatttttattcagctttgaaaagagcttctacatgagcaccgccttgtctggcattatatattttcaaatttcctccatgcttttcacagaaaatacgagaaatatacataccaaggccaaaatgctttaaatcatcttgtggattcttatgataaaatggttctgttactttttcctcagtatccacaaatcctattccatcatcttcaacagaaattataagaaaactatcctttttctttatctgcaaagcaatacttttttgtgcatatcgaaccgcattttccagtaagttgtctgtcacttccatgacaagttcctcatccactttcacaatgttttgttcctgcactctttctaccttacataatttactttccttcttggacagcatggcagcttctgcctcaatcttttttgtcagttccgataattctatctctgagcattgcagttccctctgttctaaatgggacatttttctcatgttttccgtgaaatgctctatacggtcaatctgatacatgcctgtttgtaagatatcaataacatcctctgtttttatactctcagcagaaacaaactctaagagcatttcctgatacccacgcaatatggaaagtggagaacgtatatcatgtgcaattgcattccgcaaagccttctcgtcatcaatcattcgccacatctttctgttgttatctgctaaagcacttcgcatcatttcaaattctttacacaacgttcccatctcatctttattttcataggacacatgaaaatccagttcattatctgcaatcatttgcgaggcatcttttagttcctgtagaggtgtctttaacttatttttataaaaaaagaataccgcagcaacactcccaacaatcgaaaaaatcagtaccgaatatgtttccataaagtcacacatttccgaaagatgatagtccaaacgattcatctgcgattgattaggtcttgatatctcaatctcgtatttctttccatattgctgaaacacgtccgtataatctgcataatcaatatatttttcccatattttattctgcatatttcttgcaaaatgaactgtaaatccagataacagaaatgctgccgttaagctgatcacaaaataaagcagaattgtttttttcagtgacaagtttcttattttttccatcggtatccaatcccccatacagtttctatgtattctttttctgaataatccgctatttttttccttatacgccgtactaattccgttatcgttctactgtccccttccgcatcatatccacagacttgtgcatatatacgttctttatcaaacacctgacccggatgcatggataagaattcaataatctgatattcaatttttgtgaactccatcctgtgtccagctatagctactattttttcagaataatcaatcagcatttcatccatgaagcggtattctgttttttgttgatgcctttcttctctctttatgtttgtgacaatcctcgcttccaactcccgaagactaaatggtttcgtaatataatcatccccgcctgaaagcaacccattaattttatcatcttcgtcaactcttgctgtcagaaacaaaatcggacataacactttactgcgtatcagacgacatacttcaatcccatccatacgtggcatgttgatatccaataaaataatatccggtttcatttttattttatttaatgcttccattccatctgcagccgtaatggtttcatattgtttcatattaaaataactacaaagcattttcaccaattctttatcatcatcgacaattaaaatcttgtatttcatccaaaccacctccagtatctatattatacgataaaaaacaatgaaatcacaacaagagtacatgaagaacgtaagcacaatatgactggatgaatcattttaatccaatactgaataaatacaacacagttaaaaagaaactcaaagctaaagttacggaacggaaagaactgaatgtgcaaaaggataaaaccagtattttgaatcccatgttttctcccatcgtgcatgggaacttgaatatcagaggaaacaggagatgcgacaaaatcagcctgctcggactaagaaaaaatcatatgatatagaattataatttctttaaaaagaggcgcatggatcagcaaatccatacgcctaatttatatattgttattattccttacaaattctttcaactacacttttctgactcatcttttcaaactgatactttggtatcacatacgcaatcccaaccaaaattggaatcataagcacacatggcactatcgtaagatgcagccggaagaaaaatgccgtaccgagcgtatttattaaaatctgctttgctccaaccacaactaacaatactgcaattataaatgcgcctcccaaatataggaatccctcagccactagcatttttgatatctgttttttcgtcattccaacaacttccaaaagtgccagttctttttttctgctaattacagaagttgctgttgtattaaagaaattcataatgccaataaaggctaaaataacgacaagaaaactaccgatcatataatatttgctgacaaactgctgaaaactctccttcatatccaatacagaaaaaacatttatcatatcattttctttcaaaacatttttatcaatgtattcttttacttgcttatcctctcccttcttggcatcgatggcagcatacattgctgattgattttctgtctgggtgatatactcttcttctgggaccattactgtaatataaacagaatctgcatacggataatccagggaatatggcatcatagcttctccgatcaccccataatctttctgctttccgtttccgtactccattttaaaagtttcgccagactgataataagaaactggttgttctgtatatttatcactatagtccacaatcacataatccccacttttaaacgtatcccaggaacatttttcccctttccattctaacatatcaaacaccgcttcactaattccgagaaaatgaacctttacagtattatccgcttttgtttcctcccagatttgcttttcataatctgtccagttttctttgtttttttctgccaatgtctcccacgttttcaaaagtgccggttccatcttatgtctttcttccgaataatacacatatcctgttttctcactttccggacacttattcagaatctctttgatttcaggtgtaataccgttgaaatttgtattcgataaagtgtcggtcatctgatccagttgaaaatcggaagctaaaagcacttttcggtaagaatcaaaatcatatccctgcaccaacatcacgatacagttgacaaccaccatagaaagagcgatagaaagcataacaatcaatccctttttccaatttcgtaacacattttgaactgccatcccccaccaggttacagaagtattcttttttattttcctatgtgactgctctccttctgccaaacgcagagcttccacaggcgaaactctttccaccattttacaagcctgcagactggagagatacaccgttaaaagcgttaaaagtatcgctgcaaggaaaatcaaaggatttgctgatactactgtctgagccgtttttcctgcctgtgcactaatttgggcatctgcagtcaaggacggagccatacaaagacctgcaagataaccgaagatcaatccgattggaatccccactgctgacaatttccatgcctgcatacgtacaatttttttcaattgttttcctgttgttcccacgttcttcaataatccgtaggctctaatatccgttttcacggatatattaaaaatattataaataattaagtaaccagccaatatcacaaacagtaccattacaataagggaagtgaatgaaaatgaatcctcttcaaaaagattatatgccggattgatctccaatcctgtccctgctttcgtaaatcctgctgtcttagatatattttctgttttcttttccagattccaaagattcttgtaccagacagaatactcctttcccccattatagataccattttttaattctttctgtgtaacaggataacaattctccttcgcataggcttcagatacccaggccatctgacctaaaacagccttatcaccctgccaaaatccacatatctggaatgtatctgttttgtattgtttcagcattggatttacttcccacgtcagcgtgacttcttccccaatctttggtgtaactcccagtgcttccagtaccaagctgctgactgctacttcattttccttctctggcagtcttcctgtagttggcagacaattaaagctttctgccatatttttatctgcatatctaacttctactgaaaagccaaaatgtttatctcttcctgctcccagaaaaatgcctgttccatatcgttccacctcatcactttgttctattgttttttgcaatctctccgcatcttcttctgacaaattctgcgcaatagcatgggatgaatccataaattgcttaatttccgttgctcttttggaaagtatcatggatacgctccccacaaagaggcttgtaaataacagtgatgtcaacatgattgcaataacagcaataatatttcttgctcggttcattttcataaaacgtttcgtcaataatcgtaacgtttctttattctctacttttaccatataatcgccctcactataccaaaccactgtctgaaacaatttttccgtcttcaatctgtaaaatcctgtcagccatctgggcaatctcctcattgtgagtaatcattacaatcgtttgatgaaaacgcttactggtgacttttaaaagtcccaatacatcctgactcgttttggagtccagattgcctgtcggttcatctgccagcaaaatagcaggttttgccgctaatgctcttgcgattgccactctttgctgctgaccccctgacagtgcacttggaagattttccagttttgtccgaatacccagtgtatctatgatttcatttacataacctttttcaatcttttttccatccagttttacaggaagaacaatattttcccatacattcagcatcggaaccagattatactgttgaaatacaaatccaatatttctacgcctaaaaatagtaagttcttcatctggcatatggcttaaattctgtccgtcaacaatgacctgaccggatgttggattatccaaaccaccaatgatatgaagcaatgtagactttccctatcctgtcaagttatatccaaaaaaaattgtcgatttttgcaattaaaagaaaccattcttatcgcttcttctgtactggaaaaggatttttcctttccaactcctgtccctgcatttccatcttttttataaagatgtgctgctggctgtcagtttcatattgaattgccacaccaagaccttttttcataaatgcagcaactcccatatctacaaaagcctcctgcccttctttctcctgaaaactgattttagggaaagccccggataatttttccctaatatacagttccattttttccaaactctcaaatggcatagcctgtactctttgtaatagctcctgcaaacgttcctctctcataatacatctgcaatgatcaacaccaaataccatagcaaggctgtgtccgcaatcccaagatacatgaatctgtccggcatcatctacaaactgtacggttcctaaatcaccgggactcagttttacatacggatcagcttccatatcttccaactctacccgacaccccggtgggtacatatttcttaacacaattctttccgcattacttatcactgttttcttcctttctccaatccggctaccgtcccaaagacttatctgggacatttccctccaacaaatactctctttctttattccattccagcaccttttccatagcagcttccaactggtcttctgtcgtttctcttgtataggttctatattcctgaaaatagtcttccaaagtgttctgctgtatctccagttcctctttatcataacaatccggctcttccagctccttcaactcctgcaagatttcccagcattccaaaacactgtctatctcccgcatttcaagcagataagataaaaatgtttcctctggcataatactgaaatagcaccggtcaaaccattgctcaatatacatgcgttcatcagaaccattggtatgtgtaccacaaatcaaatctgcaacaaagttttcaaatagttcaccgattgatagcccaacttttccagacttcctacagagctcttctacctcatcttgatacaacctgatagaaatagtccgcttcaggcttttttcatagggttctatatcttcccctgtctcgcagaaatgcagatatgtatccgtataaatgttttccatatcgcaaaatctccggctcattgccacataatctttactttcccggtcccattccagccggtaatgatgttcccttgcatgttcctctaaatctttccgtatgatatttctggttgcttccggcaactccgcaataaaaatgcttgtatctggaactgctaatactctttcttttaccacatttgtcctccttacttgtaactatttcttgcacgcggcaaattccccagtacgtccatatagaggataattccctgcgagtccagatgtacggtaataaatttctgtatttcctgtaacagatcatgatcagaaaacccagcctggcagccaataaaattcctgattttttctacaatatcccgtttacggaactcttgtaacaccagaatcggaatcgtgtgctgacctcccatagcattatatgctagcttttttcatagtctttccgtaaaatatgtttcaagatacatggctcttctccccttccttcttttctaaattttcttctaaataaaagaagaggaaggcaccgcagcgttttcctcttcttttattagtcttttctgactgtataatcgtattataaattacttagcattaccggctgaaaatttttaatatctaacctttttgcaaaatattccatattatctaaatcactttctgagaaatatgaaatataccatttacacgaatgtaatactctctttctaatctcaacaaaataatccatatctacagaagataacgaatgacctaatataaatatttcatttatatttataagagagtcaaaaaaattttgattcatttgtataataccaaacgtatctttatatgtcttttgaaaataggctttaatgatttcttttgtttcagttattctaaaatcttcatcatcatcttgtatatatattccatgttcttccgctgcattaaatggagaaacagctccgtactgaaaagtagaaatatcatgatgtcccactacaagtttcttactgctcagggcttttccatgaatgtataaaatattctcagcaggtactttatatgctctttctaatgtatccgtataattaaaatttagaatcttacacgtattatttattatacgctttgataccaaaggtaaaacgtttgtatctatttgctcaatccatttcttaaaataatatggaatataagatgcaaatgccaaatcctgctcaaccataaattgaaagtcatgattagcactgtctttccaattttcgtcaccataatcaagataatatgaagcattttcttcttgcacttgatatttatctaattcgcctaaagccatttcaaattgaaaccacaattcttcttctggtatatatttacatatagcttcataaaattcacgagcatatattctcaaatactccttaaaatcataatacgaagtgggcaaattgtgtgcccgatcaaaaccatttcctataataaccaatctgtccaatttcttttctctcctagtaaatatgttccaaaaatgtttgcactgctacacaagcagctgttagacttccgataaaagctgttaaagatactattaacgaagaagccatttctagcagatgtacaattctggaaacattttgatttgtactattaggaaacagtaatctccttaccttctgtattaaaaaataaaatgttttaatgaacgagataagtatataacacaaataggaacacacgattatgccccctatgcaaaatcctatatctcccaagtgagatccttttttccaattaacaagaatataatgtatctcccaagaaaatataattaaaacagaaaatgcagtaatggcatggatgcttactgtaactatctttttctctttagtttctctcgataaagcaggaaaactaataaaccaaaatgcaatacatgttgctcctattgataaacgtgtttcatttgctccaccactatataaggctggatatgcaccaatcgttaacattaaacatcccattaacaacaaacccatattaagactaagtgctattttccttttattttcacgtatcaatgtacccattttaaacatctccattcgtattctatttctaagttaaattattaacctatcatattttctttggtttttatattacttttaatgcttatttttctttatattttattgtaccactttttcaataatcttcctatatcttattttcataatgatgtcgagaaccgccaatactctttcttttaccacatttgtcctccctgtttgtaaacattccttgccgccggctggtttcccaatacgtccatatagaggataattccctgcgggtccagatgtacggtcataaatttctgtatttcctgtaacagagcatgatcggaaaatccagcctgacaaccaataaaatccctgattttttctacaatgtccggtttacggaactcctgtaacaccaaaatcggaattgtgtactgccctcccatagcatcatagggcaacgatttccgtaattcttctaagagatgccggtaataatcaactaccacctggtctgttttccacgctttttcctcacaatcccggagtaaaaaatcatactctttttttgcctgttccatttctttcaggatttctactgcctccacagagcaataccctttctcttctatcagctccatcagttcttccatagaatatgtttcaagatacatggctcctcccccatcttctttgcctaattttctcctaatacaaagaagaggaagacaccgcagcgttttcctcctcttttatgaaatctttttctctaccggaatccaggacaataagctctcccggttctttcttattctactgcttccagaaattcgtccctgtatttccatacaatttcaatatgttccggatcataaaaatttatgacttcaatcagctcatgcagaacttcataagacagctcttccaatcccttatattttacaaaaagttgcagtccctctgatttctccttttgtttttcctcctccccctttaaaatttttgcttctatctcctgtatcttttgctgataagctgctattttctccatataggtttgttttcgtgccaggtaatccttcaaagaaatctgttcttctacatattgttcatatagttccattttctcctgtttgcaaagtgccagcttcttttcatattgctttttccgataccggagtttcggaatattcaaagtctgattggctttctttaactgctttatggtatcctctgcaagggctgcctgctgtcttatcataattagcaccagttcttccaactctttctgcttatatttctttggataacaggaagcattgggggctgtcgtaacacttttacaataaatcggcttttctttgtattctgtccgtatccgcattttccgaccacaatgcccgcagcggatcaggcctgcaaaaatattctcagaagacggtgtagacccatgatattttctgtccttctgtaccatgtcctggaccttctgaagctcctgctccgttacaatcgcttcgtgtcctccttttacgcaaatccaatcctctcttgaaatatatcggtactctctttttgacggaaccctggtttctgttttccctcttaccgtcagtcctgcataaaccggattaaacaaaatcagctttactaaatttccgtcccagaatttcacagatttctttgcttccggcgcccagcctttcctttgaagatatacggtaggtgtttcaacttcttttttattcaggtccctggcaatgtctgcataggtctttccttccaacctttggtcgaaaatcccccttacaacggaagctgcctccgtatccagatgaagttttgtatgaacaccgtcatggaagcaatatccgtatgttgggattgaaccatgatattgtcccatttcagcctgtttcctcataacttttttgatattgtcggaacaaatctggggataaatcccattgattaggttcttaaatttaatctccgtatcctttctttcggaaggtttctggctgctgtcataaaaatcattgattgaaatgaaacgcaccccaaggaacggaaatattttttcgatatagttttgtgtttctatggtatcccttcccaggcggctcaaatctttgacaatgatacagatccgttttctcctggtaatcagccccatcatgcgcttaaattccgggcggtcaaaggttgtaccgctgtaaccatcatctacaaagaagaaaacctttgcccctgcaaattccggctgtttttctacaaaatgctggatcaaaagcctttgatttttaatgctgttgctttcctccattttttctttatcatctctggaaagacgcagataagcaaaaataaaatcatactgcatacggaagacctccttccatattgaccagttctttttccagctccttttcaaataaatccccaaaccagaacacgatttccacatagtctttggaatataccgtaatcttttcaataaagcggtcagcaatccctttctctatcttctggaatctttggtactttagaagttcctctgtccagtccattcttgccttcacctgatctaacaggttctgtccacgaagctgtacctgcttcatattctgcttggctgcttgctgttcttcctgatagattgatttaatctcctgatattccttgcagtccaacagtccggtagcataatgctcaaacaagatttccagttttcttccatatttctcatacttctgtctggcattttttattttttctgctacctcctgctccagcttttgataaaactctgcaccataggtcttcttactttccacagcaagctggatctggtagcggagtgctgccttgactgcctgattgatgtagatttcattcaccgtgcggaaacattccgtatgatctgtaagggaaaaagaagggcatttataaaccatatatttatgtttctcattgcctccgctcctgcaccttccaaggcgttttccgcaatgtccacagaaaattcttcccttaaaagaaccatctgccccctgtttttcttttgggtttgcagcccagttatctaacgtatctttccagcgttcctttgcaatttcctgtgctttttcataaatcgcccgttccacaactgcttcccaggcattttcacacacttcccactgctcttttggtatcatctgaagaggaatattctgtgcaagcatctgttttgttttcccataaacagcagcaccaatgtaaacggggttctgtaaaatcttcctgataccgtctgatctccataaccgccttttttccggctcctttccctgtttccttttctgatagctgtcctccggtcctaatacctttctgccattcagttcccttgctatatcatagcttgacatttcttcaaacacataccagtaaaaaatctgcaggattatttctgcctcctctggttccggcaccagcttcttgctgttttcctctgccctttggtatccataaggaggtctggaaccccagaactctccccgctccctggacagccggtgtgcctgtaccagtttctctgaaacttccctggcataataatcattcataaagtgcttcaaaatattggtggtccggtcttctacacaagccgggttcgcactgtcatattcgtccataacggaaacaaaccggatatttaaagttgggaaaattacatcaatcaaatctacagcatctaaggcgtcccttccaaaccgggcaaaatcctttacaatgatgcagtcaacctttttatttgccacatcttccatcaactcttcaaatgcgttcctttggaacgttgtacctgtcacaccattatccgcatagacttttaccaccagcatttccgggtgtttctttgcgtagtcttcacagatctgtttttggatataaatggaatcccttctgccatgccctccgtccttttcggaaagccttacataaatataggttctcagatacttcatttccggcttgctgctttgtcttttctgtcctcttttgcttaccttaggcacttgcttccgccccctttcctttcaggaaggcttccacatgctgatccggctttgctctatttaccgtttccagcagtcccaataccttttcaaattcatcttcaaaccaaaaatgaatgataatgcgcttctgctcatatacctcaatccgtttgaccaggtttaccagcattaagcggtccacttccgtccggtcccggtattccagaaaatattccagccactcctgctgtttttcaagggtttcctgcaagtttcggatttccctttgctggcactccattgcctgccggatttcctctaaagactggtcatactttgctttgaaggtttcaaattctgtccggtccaggatttcttctgcaaaactgtcatacagttttactttaatgtttaaaatcctctggctctccttttccagcatctccagttttttgtcttcttccaaaagccgctgtcttgggattgaggcagtttttacatacgccagtatctctttcagctccaccagaacagaaatataatgcaggattgcctctgtcacagctcctaccagttttttctcactgatactatgggaactgcactgcttttcataaagggaagtcgaacatacataatagtggtggactttatctgggcttttcagtaccatgctttctttacagtccccacattttaccaggcctgaaagaagcgctagcccctttgcacctctcatggtatccattttcatcaggttgcccaccacttcatattggtgtctattgataaccggctcaaaagcattttcataccgtatccactcagcttcctctttgtggatcacaacctttactttatggtttggcgttgtggtttttccctgtatcagcactccggtgtagcgttcatcaagaaggatacgacgcaccatagttggcatccagaccggtttttccgtcagacggaaccctgtctttaatttctgttttaaatatacctgcttataccgaagaggcgtcaagatcccacgccggtttaattcttcggatatatccgtcaggctgtagccctgcattttcatgtggtaaatatcccgtacaacagaagctgccacttcgtccatgaccagcttatgtttatcctcttcggatttcagataaccataaaaagcaaaaggcgctacacactgcccggctgtcattttgacatacaaatgggaacgcacacttttggaagtatccgcagggtaaaggtcattgattaaacttttaaatctcagggtaaggaaatcacgatttggcgtgaggctgtcataattgtcattgacaaggatcaggcgcacacccattttcggcaggatacgttccacatactgtaaaacaccggaaaagtcccttccataacgggaaaggtctttgacaataatacagtctgcttccccctcttccagcatacgcagcatttcctgaaaaccggggcggttaaagtttgtgccggtatatccatcatctacacattcttttaccacctgaatttcagggtggctctttaaaaagctatggattagtatcctctggtttgatatgctgtcgctttccctgttatcaccatcttcgtcagaaaggcgcaggtaaacaaccgcacgatagatttttttaagtatttgatttttcattgtattcgctcctatcatttagattcgtcagccgattccctaaatgatagaggctactgggtccttgccatcatcctaccatagtccagaaggtttgtccaccctgtaatctgccaacaatccgctttcttccctatccctgtcgtggctttaccatttcatctgcacaaggctttgcatggcttcctctatggtacggttggtagaagcaaacccaatctttatggtgatccccttatatttcagaaaataagggttctttccggactccaggatttcccggactttctccggtttgctcttttttacatcaatcttcagtttctctacatcttgtatctctttcgggtcaatgtcctcaaacgtcatttcccgcatcttcagcagttcttcccgcgagagcattatatcccttccctggtacagcaactgcacagatacgcatctaagtcctgctcaaattgttcctgtttctcccaggtgtgcattaaatactgtttcagtctggcataatctaaaatcccataaccgatacagtctatctgcacctgaaaagactggagcagttccatagtctgtaaaatttcttccggacaataggataacctgctaagcccggataccacaatcacatcaatcatgccttttcctgcaagcactgccagcctctgccagttttctttttctatggaattaccacaccctacaccttccagtaaagtaaccacatggtatgtctgctgttcacagtaatgcaggcttttttctttttcataatacaaaagcccggcacatggaatgggaatatccagatacactgccgcccgctggggactgttcctattttctatctctttttttcctttgcagatccatgcagggaataacattcctccctgaaagatctctttatcttctgaaaacagtttttgtaacatctctctattcattgctctgcctcctctttctttggctcctgttttcattccagggctataaagaaaccggcgtttccccatagccctaaaatgaacccattttacacaccatactggcagggctttccctgccagcatgttttttattttctcaccccggtgtgaacgggagcatgtaggaccggcccggctggccgcctgacaccctgcagcaccctttcccgctgcagcatgtcccagacgctaccctggttgcagtgttttatgcaaaggtatcattatcattcggctttcagactgcctgccacccacagcctatgtccgggcgctgctcacactttcccttcatcttctacgattccttgtttgatccgcttcttttctgccttacctgctgccactgcggacaagtgtatcttcgcacagctcatgaccctgcatcatacaaaatagaatgtgccgaaatgttttgtgtcctttaagatatttctatagattagcgtcagaaatgacacgtttgttttaaaaaaatatcaccatactgatattcagttttcaaggttcttcccggctgaaaacatcagcctgccaaaagacaccataaccctgatgtgttttggcagactgttttcggtctgcatttctctttatttttttaaccggataatcatatctgcccaaaattccgtacatgcctgccgcatcaactccaaaagccggtcttcggtaattcccgtaatcacgttctcttctttcttttccggttttggttccggtacttccagtgcttcctcccgtatcttcattgtgagcatggataaggaaggggaattggcacagttgataaaaccgatataatggttcaccacatcataatcacctctgcagcttcggacaatatcaaacgcatggcggattgcccgttctacccgctgccctgtcgtgccatgttgctgggccaccttaaaatacagatatgtcgttttaatcttgctgtcttcttccagaagcaaaacactgtctacaatatagccaaatccttttacattggcaggcattcccattttaaataatactgcttccaccttttctcttgataacatttcccttttcctccctatctgtattctcacttcctgctgtcttgctgatatttctttagccctttcttaattccctctatggaatagatcaaaaggctagtttctctttcatcacaatcctgtaccagataccagattttttccttcaacatcatatcttttttcgctgtacccatgtgtataaagtgttcttttatgggaatatccatagcttccaacagccggatataagttttcattcccataagtctggcatgtgtttcaatcttcgccagatgtgatacggaaatatctgctttctctgcaagctgctcctgagtcagtcccctggattcccgcaaggcttttatggcatctgctacaatataaagttcattctgcattcttttatctcctcgttgattacaggctctattataattacaaatcctttccctggtaatggactatggaggcaagatttcccagtttcattaccatttctttccttttttggttttagagatttattatatctgaacgagttgaaaacgatttttgcaccatttacgaaaaagcactgcattatctcttcaattaggcataaaaaaggagagaacgtcacatatcgactcctctccaatagcttctattcatctaagatatttgccaatacataggcttacttgttttttctttccaggaacctccgtatctcttccacactatctaatatgggaatgaacggggcagacgggctgcatactggatcttgactggacagttccagtgcattaataaatgcttctgcctttttggggtcttcaatcacaagctctgtaaggatacttgatgtagccatatagaaagcacctcttttctctcatatcttaaaaaattctttcgtaagaagatcctgcagtattttctatacgccaagacctgtactctccatttttatttatgtagtaaagtttgatccagcatgtttttaatttcatctggaagaccgtctaccgttgcattttcatctaaaaacagtaaatttgtatattttttcgcatcattcggcgctgaaaaaatatgagttactgtatatgctgttctacttttagaaaagcaatcttcatctcgcagcgattctactacaaagcaatcgcccttttgctgccccttatcatcatactctttatttaagcatagagtaaaattaagatctgttgtgccaaacttataagttctcgtgtctgtgacaatctcttccagcataaatccttctgagccagccagcattgcaatctgtccgatatgcttaatcttacgcttacacaatgaaaaagggtgctgcggtgtaaaaaatatctgcgaagcctgaagcattttttttgctgcataactataaaacttttttgctgaaaggttcgtggccacacctgtcaagtgcctaaaattggcagctttataaagcacctcaatatatctgccttcaaatacatatagaaatcttttacctactaaatgcttcctatacagatcagcagctactttaatctcctgtacaattttctctctatcctgttgttttcccatctatcttttcccaatcatcactatagtataaaaaaacagcactggacaacttttttgttatccagtgcccataatcttaaaaagcggttttatgctggctgtcagccgcgacatccttccgaatgtctaaaatgtcgccggtatcattgagtccccggcgcggactcaccgtatctccctggtgtgggcgtaatacccttccgagtatcaaatagtcccagtaattaccctgcccgggcacagtacagcttttacgtgccgctacacgaaaccttttggcttaattatattatatgcgataccctaagaaatatcaatagtttccacaaaaaattgattggttgtatcttattataacccgttacttaccgtttcaataaacgctccctagaagctgtatccaatactattttatgaaaatccagcattgcgtgctcttgcatcagtttctcaccaagtttcacaagaggattggtttcccattccgaatcaattcctgtttgatgatagtatcttgcataagcaaatccctcagctaccgcatctgaattttcaaatattcccactattgcatctgtaaactgtacaatgattgagctcccaaaaatcccctgcaattcttccgcattcgcatcatcatatttctctacatcaaaagacaaagagaaatcatacgtattctcttttccgtcttctgtttcataagaaattgttccaaaaatatctcccttgccagacggaagttcgattgactctgaaagctctaattcatattcaatgttattgaacactgtcgttgcttcaaacatttgtgatatacaggtaccttctttttcataaatatctttctgtaaaaaggaaataggattatactccatattttcccatatctgttttccctccactgtccgtttacacaaggaatctaaaagcaacatcattgtttcctgatctatttcttcatatacgttcatagtcagcctcctttttctttggatagtccacaaaagctctgtaagagtttatctcaatttctagttacaacgtgatatttagtcaaatgacgtatgtacgcgctttcttatagttgccaatattatatggcgtatctcccaaaaattcaatcagaatataaaaacttttactcacactatcctgcctttacatcttttttagtctataccctacattgatcaatgtttctataatatcatgccccatcttttttcgtatcttccatactacgtgttccactgttttgtacggaatctgatcatcataataattactctcccagaccgaacaatagatattcttctttggaataacccaatttggcctttgggctaaaagatacagaacttcaaattccctgggcgttaaatctatttcctttccttcgtaaataacctgataggacattggatttaactgcagttttccatcgcccaaaactacattctctttatattctggaaaaacatacttcatctgtatgcctcctcttgatttataaatttctaactgttcccattccagaaagaaataccgaacgaaatatccaacatccggcacttttttagttatttttactttttacataatttctatctctgccatcttttctataattgtgaacttcctgaaaaattaactctcattttctaaaaatagtttatttcagccgtttacagtgaattttataaattcctcgtagagttaattaactctcagaattttactttaaatccgatggaaacattgaaaacactcagttgtttcaatcgagcgttaattttcacagaagttcacaataatatgaatatgcttcttacttttcagattagatatgttccgttttatgcaagcgcctaattttaaagttgtgcatatccaccgaatattcatcctataaataattgttgggaaatgttagaacagcagcatttctctctatttccaaaaggagagtaggcatcatgcattaccctttattttttaggttctcttgattatataaatcttgatatacactacaatttttcaataactctgcatgtgttcctatacctactattttacccccatctaatacaattattttattagcatcctgtgcaatttttactctatgggttatatatattgctatcttatttttactcacctcaaaaaaactcttaaaaattttggtttctgctgttacatctaatgcggaactaggctcatccaacaaatataaatctgcatttttataataggttcttgctaacgctattttctgccattgaccacctgataattgacctccttcatcaaaccaatttcctaatcctctttttagttcgtatcctctttcggtttttaaaaaatcaacgtttgctttgcacaatgaatttttaattttattttcatcgacttctgtactaatatctcctatataaacgttctcttccaatgtaccttcatactttaaaaaatcttgaaaaagaacagatatacaattcctgtaactctttacatcaatattctccaaatcaagattattaacaaatagcttcccactagtaggtttatataacccacataaaattttaaataaagtgcttttcccagatccattttttcctacaattgcaatctgttcgtttgatttaatttttaaattaatggtagatagtgccattttacattgaggataatcgaaagatacgtttcttagttcaattgtctttatattatctacttttgtaccacctaacgcattctccccttcttttatttctaaaaaatcttttagtaattgtatatataaatttgcgttataaatagaataaacattagaggcaatgctatttgtagcattttgcatcatggacacagcatttaaatatgacatagtggttcctatcatttttttccctacgtaagccaaatatattgcaataatcattataattatacaaactatatcttgtataaacgaaataatcatatttaaaacagctctggttttttcaatttcattggcttgttttatgaaagttttgactaagctacaatatttatccagcaaatatttttttaatccatatgcttttacctctttaaatgctgtatcatgtgtaagtaaatatgtataataccacgcttttctttcttttccactgcgctcatatctcattagaaattctttattaccaacataaatttgtcctataaacattaatattgacacagcaatcattataatcacaagaattggattccatgaaagtagtatcattgcggctgaaaataacgaaactaaattagatgctaagcctaataccccttgcatggtctgatatggtttatttccaatttcttgttctaaacgatttatcatatcatatgtttctgttctctctaacatttccaatgataaatccccacattttttcataagaatgtaatttattccataaactaaatgattgtttaaattgtttaaattatagcttgctaaattctgtaaaagcgattccgagataattagcccgaaatataaaatcaaaagatacaccacatattgatatgattgtgtcttgttttgtatttcatttaacaactgttgcattaccaataaggacgaaacaggaagaattccatttattatagacaaaataaatgccagaataaattttgctttacatattttacaaattaatcttatcgtataataaatcaaaaaaatattcctttttattttttttagcatgatttttctcctatatagtgaaggcgtagcacatatagtactacgccttcgtttttactacctcttagagagtactagaacggaatgtagcaacagcatttactctgttacctgtacgatactctccttcgccaccacagccacagccacaatgaacacaaccatcatcattgcctctgtaacctgcatatccatcagtacacatgcatgctctcggctgcactcctgatccaggtgttcttccaattggatttacaaacttcataacgattcctcctttctttgtaatttaaatacatctatgtaaatataaacgtatttacctttgttaatgaatttccatttcattatattgttccaattcgcttggatttgcctccattaatgcatgatatcgtcttaaattgtcttccaaatactttctttcgtttcgacatgaattatgtcgatatgaaagatgtaatccattagcatcgtagcaattaacataacataatgtacataaattaactgcccaacattctttacaatactcttttgcttcttctataaagtcttcaacataaagtttcttaattttttctttatcaaatccctcattcacattgcctaaacaaggtatatttcctactttttcacaatgtaaaaattcaccttttgtagtgacataaatccttctttgtcccggcacgcagcatccattcattccatactgttgaataggtgtttctgtcaacaagcgtttgtgtataatcatcattcccttatccatataaccatccgtaaacaaagttttttctgtattatctggatttgatttatacacttcttcccatttcattaaaggttcataaaactcttccataaaccatctatcttcttttccttgcggtaaaaagtaatcactctctgacggtccatgatctaccgttgcagtcaaaatcataacgtctttgggaatccattcacttttttcgataaactcctgaatttttgtatactgttcaagataacctggtcccgatacaaccatattaaatccaatcttagaactctttccttccttatggaatgcttcaaatagtttttttgctcccataactgttttttcaaagctaactgtcccattaaccataagccgatttgcatcgtgcatttcctgaggaccatccaagctaataataatattgaaattatttttggcaaaatactctgcgatcttatcatttaccaatgttgcatttgtagtgattgcaaaggacatatcctcgccaaataattttttagcatattcaactgctctttcaataagttcaaaatttagtaaaggttctccaccataaaatccaatgtgcctattttctgcattttgggaatgctcttttaaaaaatcaatagctttttttgcaacatcccatttcatgttttcatgtccgaacgccctgtattctggatgagaaggatgataaatacaatatttgcaacgtaaattacatttttcagtaacttcaagagtaacattctcaaccttattttcaagaatatcatctaactctgttactgcatcacctgtcagcgtttttaatggtggagcttgtaaaatatgttcattttccattgccgacttaatttctgaaattgcatcctcaaactcacttttacttaattgaagatttttaatatcttcgactggcattccctccaataaacttttcagtacaatgtaaacgttcgaatttaatttggcaacttttccagttcctgtatcataaaaataataatttttttctgtcttaaaaactttacccaagcgcccaattcttccatttttttcgatttcagataccagcgattctaaagatatttttttctgctctttcactctaaacactcctttcatttggattttttattatgaaccgattatatcaataaatcccccaaaatatattttgatgtaacaatttcgatacttgatgtaataaatcctctatactttatgaatatagccctttttccttatatttacatctggtgcctacaataagttcgaactgtaagaaataagaaaacaggaatctcaatcaatgcggaaattaatatagtatacggtgtccaaaaactcattcccccaatatgtaggtaattaaaattgataagttgatacagaaaattattttgcataccaagtcccgcagatggaaaaatagctgaaatccaatttacccctaatgctgtgtaagcaaaagtcggaataaggactatgccaatagcaatcaacaataccgtcaatgtatctttgcattttgctgataaaaaaaaagtacagtaaacacaagctaaaacagatatcaaccctactaacgaaataacaatctgcatctgtgctaagtcccagtttggcaagttaataatagaaaacaacatttgaacagaagattgtaaacaatttgttccaaatgtgatatctgaaattgctaagtgcagtgtaatacacatagtatacacaaccatcacaatcatactggaagccaatatctttgtaatagctaatctggtacgaccatgctttgcacaacgcaaaatactatccgcgcctgattgatattcaccagaaaaaataggcgtgataatggaaacacataaaattgccaaaatcataatataaagctcaacatagtcaaacgcgtctttggaatatcctgcataaagttgaaatggcatatcgacttttttatattgttctaaggcttgttgttgtgcggccggatgattgcgttgctcattcctcataacatctgccagatgagtttcacatttctgataataattttgtgcaacatcttctggatcaatatccataagatcaggtcctattccagttaacggatcagcatatagttctggcaacgctttaagcaatggacgaataggtacaatctgtttaatactgacagaaagcggaaatgtgtcactttccataggaccatattcgtttatcaaactttgataaattctcaaagcctcactcactttttctggagtaacttcgccatttatagcagaatataaatcacgcttaaattcgattgcctccataccatcaagttctgtttttgttccatctgggtttggacgatttatggactcaaaagcaatcggcagatatgccataacaacagacataaccagagccacagcaattaagataagtgtgcgtcgtgatttcaggacacgctttacttctaaacaaaataaacgcatattatttttcctccctttcgacatcttcttgtggaaacaaccataaatacaaatcttccaaacgcggctccgcaagaatggaaccctctacttcggagtgctctgcaagataacgaatagatatttgattattgtcctcgcctcgctgattgataatcctcagacgcatttcatagtccatcatcttatgagcaggaatcgcacagctccatactttcccctcaatctgttttaccaaatcgcttgttgttcccacatcaataatctttccagctttcataatcgcattacgagttgcaatatattcaatatcagaaacaatatgcgtagaaatcaacacaatacggtcatgggaaaattccgaaatgaagtttctaaaccgtactctttctccagggtcaagtcctgctgttggctcatccataacaagaattttagggtcattcagcatggcctgtgcaattcctacacgacgtttcataccaccagatagttgtgcaattttttttcgcttcacatcagaaagggtaagaatatccaacagatagttgattttctttgtggtttctctgagcggcacatcctttagtgcagcaacatattccagatagtctttgaccgtaaaatcgcgggaatagccaaaatcttgtggcaaaaagccaaagatattgcgataatctgctcccattttatgaatgtctttcccatccaaagatatacgaccactactaggtgtcataatgtctgcaagtattcgcatgagagtggtttttccagccccatttgcccccaataatccccatacgccagttgttaatgtaaggctgacatcatcgactgcagttttatctttgaactgtttgctgatgtgttcaatctttaattccataggtgtactcctttctcttaaacaaaaaactgtccttgttcagtaactattgtaccgaacaaaaacagtttaatctcaaagatatggaacaaaatctcctaagaaattcctaagattttacttctaaatgcctaatcagaaatgggaagcataatcacaaaagacaccatctcattttcgctaaacgcagtaatggttccaccatgtaatcgtataatttcctctgcaatcgacagtcctaatcctgcaccgcctgtatcagaaaggcgggcttcatccaagcgattgaatttttcaaatatgccagaaatttgttcaggttcaatagtccgtccatgattttcaaagtttatttgaacgctattaccacaacgctttgcagttataataatctctgtattaggatagctgtatgccgctgcatttttcaaaagattactaaaaacccttgccagcttttccggatcagcatatacaactaaatcatcatcaaccgtaaaagcagccgaattgccttttgcagataaagagggatatatttcatcaactacctgtgccaacaaacactgtaagtctaccttttctttctttaacgagacagtgtgtgcattatattttgtaatttcaaacaattcattgataagcttttcaagtcgttcagccttacttaatgcaatttgaacatatttttctttctgtttttcaggcatatccggtgcttcgtggagtaaacttaaatatccaatcactgttgttaggggagtgcgtatatcgtgggccagatacataacaatttcatttttcctatcctcagcttcttttgctacctgtttgcttaacaacacagacagtttaatctggttaagttgttcctctaattctttaaggggatcagacaatgctacaggatgatcattctgctcataaactgtctgtgttgcggaaataacttcatccaaatatccccatggttttttccagaagtaattaaatatacatacaaaaccaatgattagatagaaaataaaaatcatatctatacgccagtatagccatgataaaattttgctatcgaatttcggaaaaatgaattgtgccaaaatttccagtcctataccagttacagtatataaaaatagtactaaatataattgtactccaagccgcttttccgtagtaagttgcttttttttcataagcacgcctccaatcaatttaaaaataaaagaagtgccaacagaccgattatgaaggtgctcacaattacagcaataaccaaaaataatttatctgctttttctcgactttttagcaatcgagccacaatagaatataaagcaatacccaaaagaccgcctgctgtgttagtaatcaggtcggtaatatcagaactaccaatagcaagtatatactgtgtaatttccagcaatagacttattccagcaattatcaataatttcaaataggatttgctcttaaacaaaagcatttgcagatatatgcccattgggacaaaaatcaataaattttcaagaacttcttttatgtgaaaatctactccaatctctttatcgtaataaaatggaataatatttatctttcttacagtgtctaaatcattgatattgaattgcagcttaaataatattatccaaaccaaaagtgccagataaatcaaaaaaagaactgacaccccaaattttcgctttcttttcatgggttctcctttcagattttataacctactccccaaattgttttgatatatttcggggtatcagaagtatcttttaatttttcacgcaaatgtcggatatgcactgtgatagtgctgctattttttgaataatattcctctttccatactgcatgaaataaatattcaatgcttacaaccgtcccggcattttccaacaaaacattaagaattgaaaactcggtcggagtcagcgacacattctcaccatccaatagacattcatgtgtctgcacgttcaatcgtaatttattgtatgaaagttctggctttattccttcttcacttgtaacggatgaatattttttgtagcgtcgtagctgggcttttactctgacaaccacttccaaaggacgaaatggctttgtcacataatcatcggcacctaatgtaagtccagtaattttatctgtttcctcaattttggcagttagcataataatggggtaagtatatttttcacgaatacgctgacataaggaaaaaccatttatatccgggagcataatatcaagaatagcaagatctatatcgcccttttcaatacaaggtattgcatctttagcacagtaatatttataaacaatgtaattttcattttgcaaataaacttccagtaaatttgctatatccttctcatcatctataactaatattttttcgcacataccatcatcaccctctttccataatttgaattataacaaatttcctttatttattcattatgattttcattaaaaactattaagattttcataagaacttttatatatacaaacacttctgccttttcgtgctatttaattataatcctattaagaattcttgatatcgttatataaagctctattacttaccagatgttttttgtacaagtcaacatctatcttaatttcctctataattttttctctatcttgttatcccatgtccattatctttcaaagcaattttatgctgactgtcagccgcggcatccttctaaaattgatttttaagctaaaaggtataaaagcaagctaaagttttccctttcttttctcaatattatgtgttagtgatttcatgagatgtcacaagattgctcacatcagttgacgctcgtttggttaactttctgtcaccagtcagttaggcaataccgcctgtttccaggcggtacctgctttatgaagttaccatcctaagcatctcgtgttccacaacgaacttgatcatataatcatcgatcaatcgtttctgattttgaaacgcatacatcaaagctttttcacagacacggttgatcatccgtgggattcctgcagatgccttatggatctcatccaatgccttggttgtaaatatctcttgcttacatcctgtacagtgcatatcgatgcgttgacggatgactaactgtttcttcacacgctttccttttgtatgctgatggcagtatacaggttaattcagagacaggcaagtaaatcagttgtttgatgattcatgaggtcaacaacaattatggtatctttgtattccgaaaaaatattctgcatcttttcctcccacaacagtcttttctatatttctgtacagttttaccattttaaataaaaaacgcggaaacaataatattttatcattcccgctaatttttctctttttcaactttatactttatgatgccgatacattgtgatataaaaacggtcaacgctgtcaacgcaatcaaggataaatattttttcatacctaaagctgtacaacagccagcagcaatgaaaatagctcctagtattttacctgttacttttcggcaatgttccttttcttcttttttcaactcatggttaatgttttctacaggagaaagtttccatatacaaatggaactgaccaaaataatcccccaagccacaaacagctctaatggatatttgttattaatttgcaaaatcataacttgaacagtaacagagcatataaaacaagccttaaagctattcagatgtacaccaccagcataggttcttaaaaacataaaaacacctgtagacacaaggaattctgggattgtatgcaagtatatcgctatactcatacagacgaataggcaaattaacatctctaatccaatctgaaatccatattgatatactgcatacaattcctctgaaactgcaccggcatcaataacgtatcttgttattttttccgataatcttcccatgaaattaaagtttcttcatttttttcaatgcttctggcatctttggctgatgataaatataacagcaagcactgtccgctgacattttaccaagtttcagagataaatttgctaatacttttgctggctgattttttaaatttttagatttcataattaaaatctcctttcatttgtttaccaatacattactacaaaaaatttcccattcggttctcttgtaaaaaaaccgagtattgatgtaatttttcccaaaaaggcagcaaaaaagaagcaatgtttctccggttctttctcaacattgcctcttttttgctgatgtatgtttttttatataccaattccataaaatcaggttctctatctttttcttatattttcgtgtgttatctattgtttctatataatcgtaagctcctgctttcagtatagaaaaaatatcctgtattgatcccccttcgctaatagcaagaataggcgttaaatgccccaaactcccttttatttttataatagccgcaaatgccctttccctctctattatctctttagtaaaatggaaaatcacaacatctgccgttggatatctattgttttccaactgttgataagtacaccattttaattggtgttttttcccaataatcctttcagtactgttatacagtttctcatcatcactaaacagcaatattttcacgctatccatatatcagtccccataccgcataccaaatttatctttccattttaccattctttcctttctcattattttttatgtaattatttcgagtgttcatgtaattattcctgcacattactatataagactatccgaattttaaattttcctggttctgaatcctctattaccactgatccatgatattttgctactgcccgatacacagaggctaaacctactccatgattttctgcatctgactttgtagatttcaagcggttatctcttgtttttaacagcttccctttataactattgtctacgaacaataatagattatttttatcaaatttcattttgacatttatatatctattttcttcaaccttctctgctgcttccactgcattttccagtaaatttcccaatatcagactcagatcagctcctttaaaaggcattatcatcggaatacaaatatccgttttaaaaattattcttttgttttgggcagttacataccaatatccaataagtgaatcaatcacaatattcccactattcgatattgaggcaatcaccataccgccctctcccataatttcttcaataaaacctgtcattttttcatattctttattttctgcataagcaagaatggaaataagattattcttcatattgtgttttatatcccgcaactgcaacattgaaagttctctttcttgctgatgacgttcgcataattccagttgctgttcatatactgctgccattctccttaaccgcaaatcatcagccaacttcatatagacataaaatatcaatatgttcataccaagtaaaataagtacagtaaatgtagagtttatacgagtacgtccattattatttgcaaatccaagcataaatatattgttcatgatataaatgcttcctgttgggatcaacacaagtaaaatactgtatctgaccggcaattccttaatatcatcatctgtgaacactttctttaatgcaagaattactgcattaaaaaatatttttgaaacgaaagagcctacttggcgaactgcagcatattgagggcagtatgttagcaaaatatagttgcacagggtttccatcaacatccaaatcgcattaaaggtaattacaaatacacctttgttccaccatctaccttcataagtcatcataactgccaaaaacgtaaacataatcgtcacagcaatattgatgtaggcaggaaaactaataatcgttgttattccaaattgccaaatcacgaacagcgttataccgatcaccgacaaatacctttttctcttacgagcaaaaaatatatcgaaataaaaaaagaataaatatactgcccaaaggcaaagcaatatatctatcccacacattaataccctattcgtccacataaaacgtatcctccatagaacaatattgttcactaattatctttctccggtcttcactgattgaaattttttgtccattatccattactacagaatcataagattgtccggatatatgtttataatccaccagaaaagactgatgaactcgcaaaaaagaaattttacatgttttaagggtttcttcaatctcattaagttttccgtacagttcaaggatttcttgttccgttacaataaatatttttcgtttgttgctttcaaaatataaaatatccttgattggtactttatgattcatacgttgataactatagcgaaaataaaaatcttcactattaatgtcttcatataccgacttaaagcacttttccattattttatctgttacaggttttacaagaaactgaaacggtcttacctcaaaggattccctcatataactttcatggctcgtaacataaataattcgcacatttttatcgtatgttctaattcttctagctgccgaaataccatcttctttatccatttctatatccagataaataacatcatacctctcacctgctgcgatagcatctgctaaactctttccattccagaatacttctatttcagtatcaacaaaatttcttttagctatatcctggagaagtctttcgatttttccagttatttgaatatcatcatcacaaattgctatatttaacattcactccactctcttctgcatgtttgctgattttttcttctcactcgttttttttactatttgtataattgaccaaatcatctcctgatcacatggatctaactctttatacacttccactaaatcgtaatattcgtctagtacttcgttcattttcatctgcccattcaaatctctttttacatctgaaactcccagcaaataatctgttgttacattgaagtaagcagcaatctttttcagaatatctacttttattaacgtaacatctctttcgtacttactcaacatttgctgtgttatccctaattctactgcaaggatttcctgtattaaccctcttttctcacgtaattgtttaatacgactttccataattgcctacctcttaatcatgttgtactatcatgctaccctatttcattcatagcgatacaaataatagaagtaatcaattacgcaaaatatgcaaaatacgaagacgagcagtgcaatcgcactgctcaaatcttattcatgtagccatataaatgatgttgttgcggaatatatttcctgataaataatatccgccatttcactttcagaagcttctttatttttttctcctatttctcttcccacttcattgttatgtaagtccatatctctatgtgctgtttttggatatccgtctgattctgttcctgtaacatctttgtcttcatgagcagttgcaaataactctgctctttcttttcctattaaaacagtcatttcagcattccaaattccatgacgaaaagcatcacttctatttcctaaaccatttgtcccaaattttgcctctgtctgcgaagtagcaatattttttgctttatttacctttagggcatcaaaaggataacgaatacatagtttcttttctgaatctgtaagcgcattccaaatatctataatccccctttccacatcttgatgattggcttccaaaaaagacatgagcatttcttctgaataatctgggtgagtagccttaatgttctggatttctgcaatcaatttttcaaaatccctttcttctgcaccaatcaaatcacttctttgctggtcattttcgcttgccataacagagaatggaaaagccattatcaccaccagcattaggctgaatactttaaatagtttcttcatagaatatacctccgatctcatattatgattatattttaccatatttaatgtactatcccatctacatgtaattttttcgattccctgtgtaataattcccatagaggcattttcaaaaaaaagaatggcagtattaaacaaccgccattccactcttcatatactttttaccacagtaaaatgcaaccaaacctgtatcttccaaatttacccatttttagcattttctatctttatttcacttctatttttactgttcctgaaaaatcattacctacaatcccgatataattactgccatctggtaatgttattgtattttcataagtacctgttgtttttattaaagttttaggttcattgctaccagaaataatgaatatttcagcttctccttttgttatttctaggttacaaaacaattcaacctgcttccctgccgctctttctattgttgttcctccaaaaagatattctgtatcagaaaattttttgtactctgcttgatatgtccccgtataataatcttccccataatctcttttcccttgcaggtttatatcattggttaattgtacttctcccaccttttcgactactgcattatatttttccaacacctcctcttttgaacacccagacaataacaagcaaaacattagaataaagaaacaactttttttcacttataaccaccctttctttggtttgactttttttgtttttgtacgagtttttttgttctccttttctttcattgttgcgactaaaattacagaaatagcgacaataattatcaagctacataaacacaatggaaaactccattgtacggatgtatcataacttctatacccaattaatcccagacttgcagtaataggatatatattagccaatgtcatatttcctgctgcaaacatacctccatatccatacacaaaagcaacaatgacacctatcataaagccgcctgatagtctgcttgttataacaataattggtaataccgctagatacaaaagtaaattttccaatgttatttgtactagcccttggattaccaaatttactgtaaatccaggaaaaccaactatacactctgcaattaacgtaaatatcgtacaaataagcccaaataatattgataacattgcacatacaataagttttcctaccaacaactttttaaatgaaattggaatggtaataatattcttcaaaacatcgtctttttcttcccgcaatataatatatccagcaatcaaagctatgcacattgggaaaatcattgacatattatttttgattacctgctctattaagtatcgaaaatcccatacagatccatcattagccatagaagtaaaaagtgtcaatagaacagagagtagcataagagctatccccgcccatataatatgataacgttttaatttcaataattctgtttttacaatagtcctcaattttattccccccttttcttgtacaaacagtcaattaatagtattgaaattcctgccataatcccaagaattaatattacttgaaaagttgaaggaattaatccattcatttgtacaaggttcatattaattccatgtcttttcatatctccagcactccaaaatgttgtaagcggcgtaggaagtaaccataatattgtctttggtaatgcatcgaaaagtgctgttgcactcatatttaaaacgctataaaaaatacataataaaacagagaaaacataagtacgactaaaaaataccactataacaatcaatggtaatgttcctgcggtaataaatattcctgtttcaaccgccagaaatattttgtatcctaaaccgtatacatctaacgtaaacataccaaccagaactgttgctaccgttgatgctatgcaaaatacaacgcctataataaatagcactataatttttgctgtaactacttgcgtactggatagtgggattgttttaatatttttaaatgtatcattatcacgttcaataaaaaacaacatagcagctactactccgataatacagggtaataaaaattggattccataccccaataccatattaaatagtccgtcaaatgcgtccgctttatcaatatattgctccatcatagctggtgttgtcattaaataagccaatggaagcggaaacataaatgcagctaaagttactaaaagaataaacttttttcttttcagtttttgaaattcaaccttaactaatttaagcaattccttcacctccggtcacccttttaaaataatcttccaatgtttcttcgcataaatgaacttctgtaatttccaatccttgctttacaaaaacataagtaatttctgatctagggattgttgtattatataattgaagtctatttttatcacatatttgaaaatcatcacattcaaattcttttcttaaaatttccgctgcgcgctggctatccgataccataaaattgacatagcgactattttttttcgccaattctttcatactttcttcttcaagtaaaattcccttatcaataatccctatatcatctgccagtaattctatctctgataatatgtgactagaaatcaaaatagtttttccctgaacatcacataactctctaataaacgaacgtacctctgcaatacctataggatccaaaccattaataggctcatctaatatcagcaaattgggattgtgcataactgccaatgcaatggccagtcgttgtttcatcccaagtgaatattccgcaaataactttttatcacgatagggcaaaccgacaacttccaaagcatctcttacacacttacttttatttaatcctctaagctccgcaaaaatacgaagattttcagtcccagtcaaattaggataaaatcctggtgattctattaaactacctatatgcggtaaaatatctttactattggtttccatacttttcccaaatatttttatgtttcccgatgtcggttttgttaatcctaacagcattttcattgtagtcgtttttcctgctccattacgtcccaacagtccataaattcttccttttttcacatgcaagttcattgcagaaacactcttttgctctccatactgttttgttaaattattggtttgaataatatattcactcatttttttatacctcctttttttatactgtaattatataccaactacattgagatttccttgaagtaaccttgaggtaaccttgagattttcctctttctctatacttctttttccacaagatgtataataatttaaactataaaattttaggagataaaaatatatgtatgataaatttatacttatcgttgatgatgaacaagaactactcacccttattaaaacaatatttgaaagagcaggctatacaaaaataatgaccgcaacatctggagaaatggctttacaaataataagagaaactctacctgacatggttattcttgatgttatgttacctggtatggacggatttgaggtattgcaagaaatcagagccctcagtaaacttccggttcttatgctgaccgccaaagatgcagccgaagatcgtttttctggttttgaattgggagcagatgattatttaatcaaaccatttttgcctaaagaactattgttacgtgttcaagctattttaaaaagaagttatcctacagagaaacgaattatagaattagaaaattcttttatagatattgataaggcagaaatacatcgtgaaaataaaattattcctttgactgctaaagaatacaatatattattaaaacttgtagataatgccaatcacattgtaacaataggaactctttgccaaactgcttgtggtgaaatgtggcaagggtatgaaactaccctcatgacacacattcggcatcttcgagaaaaaatcgaaaaaaatccttcttctcctgtttcactgctaacagttaaggggctaggatataaattgctagtgaaaggagtaaaataatgaagcttgccaagcgtttttttaaaaaatatcttctttccacccttattatattgattttattttttgtactaaatattattttaatatgtgggactttactcatggcatggaataattctactgatccagatatacccgtccaaaccattagcaaaaatatcacgctcaatgtagatggaacaatttcttctactgattatatagaaaatattctaaaaaataaaagtgcctgggcgatgattttaaacgaacaaggaaatgtcatttgggaaaaatttttacccgaagaattgccaagaacctattcaaatttacaaatagccaagtttagtcggtggtacttacaagaatatcctgtttttatccaagaacattctgccggcttattggttatcgggtgcgaacctaatagtataacaaaatacaatttttcaatagatattaattatattcacagcctaatagtcggtatctttttaatgatttgttttaatatattactgatatttatattattctggcgtaatacacataaaatagaaaaatctatagtgccaatcattgacggtattgactctattgctcagggaaaacccattaccctttcagaaacaggtgaactttcaagtataaatgctgaactaaataaggctggaaaacatcttctacaaaaagaacaggcgcgtgccgaatggattaatggtgtttcgcatgatgtccggacacctctttctattattttgggatatgcttctgaaatcgaaaaaaatgaagatgcttcgcaacctgtacaactacaagcaagtataattcgtaaacaaagcgaaaaactccgtagcctaatcgcagatttaaatttaacttcaagactagaatactctatgcagcctttaataaaaaccagtttttctcctgtggaaattgcccgccaagtaatcattggctttatgaatggaccaatagacaacaaatattcttttgattttcattcatcatctgatacgattccagtattgatcaaaggagatacggaacttttttcaagaatgctaagcaatctaattcaaaattgtattaatcataatcctcatggttgtgaaataacagttgaaattttaaaagaaaatgatacctgtattatttccgtcattgataatggtggcggtatgacttctacacaaatagaaaaaatgaatagtggtatttttcctaataatatgtacaattcaaatggggagtctgttcatggatttggtctaaaattggtttaccaaatattaaccgcccataacggaaatatcaaatatgaaaatatacttcctcatggcttaaaggtcatattagagatacctattgaacatattgatccgtatgaagaaaagatctcttaaaagaacaggtgaaagccattatctgactttcacctgttcttaattatttacactatcataatatgcgccctttaactgaagtagttccacatgtgttccggattcaattatttttcctttttcaactacgtatattgtatcagcatcttgtatggcattcagtctatgtgtaactacaatctgggtaatatgtagttgtttcaaattattacatattcttcgttctgtaagaggatctaagttgcttgtggcttcatcaaaaataataacttccggtttcagtgccaatgctcttgctatagcaatacgctgtttttgtcctcctgaaatgttctgtccattttctcccacaaatgtattaagtcccaatgggaatttttctatatcatctttcagttctactaaatctaaataatgatatatttcctcatctgtcaacgtatttgtaatatccacgttttctctaattgttccattcattgccattggaacctgagtaactatggcaaatatccgatctatatcctctttgcatatttgttttatatcttccccgtttactaaaatttgtccttgataatgagaaaagacgttcaataataattttgtaattgtagtctttccacttcctgaacttcctacaaatgctatcttctcccccttttttagcatcatactaacattctctacatctggcttcgtgcttccatagtaagaaaatgttacttgctgcatttccatagactcaaatgaattaatatgctgagtaccatttttacggttagatttataattcattaactcttttaaacgaatcattgtttcctttaaaacattaatttgaggtaccaccaaagatagagtttgaaatggacctgtaaaatatccggcaagtgtgacaaaggctattaacgttcctaattccaacctattatcacaaaccaagtatcctcctataacgtaaagtatcaatgaagaagctattgaaaaagcccccaccaccgactccataatatcacttatttgtacacgctcacgtaatctcttaattaaatgcttataatcctgtttcagactatcactcagcatattctctattctcatgcaccttatttgctggatattagtcaaagtttctaccattcgtgcctgtaatgcactctgatctgcaatataatttttaacctttattctagctttttgatttaaaatcattactattgttatctgtataacagtcattactattataactgcaaacaatggtattgactgtgttatcatcattattccgcaaaaaacagcagtaaccacatctatcactgttgaaattagagctgttgatataaattcgtatatatcactgacactattaaagcgattttcaatatctcctgatgaatggctttcaaaataacttaaatcaatatcaaatattttattcagcattaaaaatatagtatctttgtatatattattctgtaaaataagtattaccctttttttagctaaatttgcaagtaaataacttaatgccactgataatatcagtaacgcatattttacaaaattgaagcctaatgtatcatacgttatttcattgactattttttttataatgagcggtggaatcaatataattccctgtgtaaccaacgttagaatacttgccagaaataatttgcttttatttataggtataagaaaagactcacgtttctcacgtttataattcttttctgttggtcgaacacatacaagtacatctaaaaaattctttttaatatatgaataatcaaccttttcttttccttttaaaggatctaaaagtatatatttcccatattttttctccgcaactacaacataatgattttcttttgaacacatgataatcggtaaacattttatcaaattttcttcggtttcgtagtttccatacgccttgaatgaaaaattatgttcttccgtaatttctttcatttttgctaaagacataccatttcttccaatacttgttgtagcttttaattcactaatatctatcttatatttataatattggaagatcattgtcaatgctgctataccacagtctgttgtccccatctggcgaatcaatggcacactttttttgtgcataaatacacctccctagtataataaattagtattggaaataataaattctattatttccaatactatcattttagacttccagagcaattacacaaggtaaatctttttttatatctcgcagcaaagaatatcccatgccacatagtcctgtcataaatccttgcaatttatatccatatagatacgcattatcgcaatcaaatacaccattacatacattctcagcaataatatcacgaatatctacataatatttttctatctttttatctgaatggtcttttaaatattcaaataaaatttctgtattacctaaattaccatgacatagacaattgtttcctaaaattccctcttttaatattgtattcactgctacttttatatcattttctatcaaatccgaataccgcccattcaatatgacatttactttagatcggctaagcaatatgcctgcagcgccatgacaccaagcaacggtaaaacttcctccatcagatgctttttctcctgcatataccctttcgtctttccaatttcctttttctttcacaaataaagaattttcaaatttaatgccatcgagcagtgataataaatactcctctttctgagtcacctgccatagttttgccagtgctaaaactattccagatgctccatgtgaaaatcccgctaacggcgaagttcttccatctccattccatccgcctttaatagagccttccttttcctgagcatttactattatatctcctgctatttctgccgaagcgatatactctttatttccagttagctgatacatattgatcaatgtaataactgcgcctgcattaccatagacaagatcaaaactgttatctctggtaatcgctttctttaatattttatagtgcttttttgcataatccaaatatttttctttatttgtaattttatacagtacctcataagtgtacattatagacgcttctccaccaaaggcgccactgctttcattttctattccctcatttcgttcacacatctcatctgtgtatgtaaataattccttttcaatcgcattgcgtataataaggtactccttttggggatcaacagcatacaatgcgttaaagaaaattgctagcccagacattccttcatataaataggtaccaagtggtcttatatcccatgagcagtcatcttcatttcctattagagtaacaccaatccaattaacttctgttctatctttattaaaaacagcagtttttataagagaatcagccaatttctgaacagcttttaacagatgagccttatttttttctctgtgcggaatcattttcatttgttgaagctctatctttttatcctcaacctgaaattcgtttatctctgtcagaataatattcatgaacattaattgcctttttaaatcatcttcatctaacaatactatctttttctttaagtgttccaaactggtatattcaaaatagtcttcgattttctcaccttctgatccgaaaagagatttacctgatgtattgagataaaaatatggaatgtccatgtttaacatgtcttttatctcacatttcacaacacctttatctccttgtgtagcttcatactgtttaaataaactacacaaaaacatttgtctatctcttccatcttgcataaaatccggatgaaaagatgtgtgtaataacatagaatatctttgggtatcctgaactaaatggcgaatatttaaattaccaaacatgtcggcatattcaagaaacttttctttattctccaaaacatatttatacgcatcttcaaatcctgcatttatttcttttagataatgaaatgctgatacattttctccatctaatttaacaagattttgatttactccagttgtaggatgttcatatacaaatctcatatttgaagtacataaatccgctattttaggaataactataggatattcctttccctcactacctttaattgcactcatatctacgccttggcccaaatttgaaaacctatagtgtggcaataaacctgagtataatactgactcatgaaggatataatttatttcctcctttgcagaatttgttctccctcttctacggttatctagtatagtttctgcatctataataattggatattctcctgcggcaatcacattttcttcatgtaaatcatttgtattaagaatataactaccgaaaatcaatattccaaatctataaaaataccgtctgatttcatcctctgttttacaacttttataatatacaaattcctcccaaccatactcctgacaatctaatatttttggttcatacatctcatatttacaaccagcatttatctttcccagaaaatcgaaatacactttttcaatttttaacgaacgtggtttatacacaattttagtgacattatccaacttaagaatacttaccccattcccttttttatgagaatccgagatattagaacttatttcaactacatttttaaattctaaacctccacaaaatttattcgcaatttcatttttatctttattaagtctttctaataaaagtacataataagaagataagttttctacggtttctgtaactgaacgtagtaaacatggatatatattgaaaagctcctgtttatacgatttcttacttaaaaaattattattataataatcgtattcttcctctgaatttcttccattcagttttcccgtcttcttacaaagatacatttcaaacattaatattccaagactgatcttccctaatctctctaataaggtatttgcgtatgtatctataatagaatccgtccaaaaaagacttgttccattttttaatatgtctattccgtaattgattaaaggtataaaaaaattatcaaatgccaatttttctcctttgaatccggaatagttataattgattggtttttcaaataattctatttttaccttttccatttctgacatcacgtgattgttttcacatacataattttcagaatttaaaacttttactaaatcaataccataacatttctcagcaactcttaatgtatcttctcctaaaatctttttccaatattcaaatatatcttttttattttctgcttctgatgttgtataacttctttctgtaaaatatgatgctctctcagtattcatgttcttaaacaccccattctgctttccatttcaactcacaattcgtatctgtactgcacaaacttcaattaacgcttaccctctttatcaacacctgtgtttatttcttagggcagcaaggtttcagcaaagtaccaaaatagcattctgctgtacttgtacataaaactccgccggaatttctggtttcaccagctcctgctacaaatttgtttaaatctgcttcctgcagctccatcataacgttaccagccggattgctaaagttttcttctcttgtaataggatttctcatttcactcataattatttctcctttcataaatcaattttgtacagtacagatactaattctaaattgaaatggttgaattattttcttctgttccttacattttagataatacaccttttatttcttgaaattttattcatgtaataaaatcgactgtctatgtaatttttgttagaatattaatagttttattttttcacatcttccatataaaaatattactgtctaccaacgtaaccgttcaaaacaaaaatcttttctacaatgtcaaaagcggatatgcgctaaatcgcatatccgctccaaattctttcaaaccgcaaataatatttccctatatattctctgcaactctcataatattcaattatcccaccatatttttcgatatttgctaggtgtcctcccatacttctgctgaaacgcctggttaaacgtcctttggctttcaaatccgaattcaagataaatatccataatccttttatctgtattttccagcagattggaataataatgatgtaatattcatcaccaaaaatgattatcaaatttcaacaaaaagatgtaaataatatcaaatacaccgtctaccttttacctcaatttttttaatcaatcttatttccgcttaccaacattttctttttttaaaattttagaagtttttacaagtgcttctattaaagttaaacctgtcagaattacagcaactcccatcataaataatgtccatgctttgcccttatcaaaggttaccaaaatagctatcgcagctacaggcatgtttatatatcctaaacttgttgcccattgaataaaaaagttcggccaaaactttttctcttcttccacttcattcactgttttcacttttttggcgaaataaagcatacagactatagatacagctatcagtattattttccatacacaattaactttcgtttcctctggtggaaaaaaggtatctatcatgataactgctattccaatgataaatgctatttcactatacaatcctgaataagcggaatctttcatgtcatttacttttttctctaaagcagtaattacagattggtgatactgttttgcacttttcttatttccgttcatgtaataaatcctccattaataataacatactatttcatctcaattatatctcccaaaaactataactttttcaaccgatacctcacattgaccaacgtttcgataatatcatgccccatcttttttcttatcttccatatcacatattctactgttctgtatggtatctgatcatcatgataatgaataccccatacagaatgataaatatttgtctttggcattacccagtttggctttaaagccagtagatataaaacttcaaattccctgggtgtcaggtctatctcctttccttcgtagataacctgataggacattggatttaactgtaatttcccgttgcccaacactacattctctttatattctggaaaaacatacttcatgtgtatgcctcctcttgatttgtaaattcaacttttctcattccagaaagaaatactggacgaaaaatccccgtccagcacttcttcaattatcagttattttaatgcactctctatatcctccgctgctttctataatttgaagatactcctggagcttttcagattggatattttccttttctgtaagtgaattgaattagaaagcaacttgtttttatgcagcttagcggatttcggatattgctctgcagttccgcccgcatagtacgataatcattttctatatccagtgtccttgttactgccctctcacaaatatccagcagttgcttgatacactctgctaattcctgcactgaatcattcaaataccgtcagcctgcaaaaggctgacggcaaaaaagatatcatatcactataaactatttttaaataaattttaatctggccaatccaaataagaagactcaaccaagctactaccactggctttaaaagtatctaaaaatgtacaatcttttgatatattcaaaccttcccataaataattaatagtacctttcatgtgaatttgtacaaattgtttattgcttgatatatccgtccaagaataattaggttcccaactgccgagtgtaaaacctgtatcataggaactgcctactagtgaaacgcttgaaatccgagaagaacttacattagctgtaaaatcttgtttaatatacccccaaccgattgcaggaatcatactttctacgcttgcagtataagatcctgttgcccttgccatattagagcgctctataagtttcacctccatattctgcatagcattcttcatcattttaacatatgattttactgatttttctatttcttccacgctcatatcgctcctgctaggtgagatataaacattttcaaaaacaaccccaactccatttgcttctgcccaagtattaagttcttgctcaatatatttgtttggctcaaactgattttcatcatttgaagcatatactggaatagtcactaaaaacattgtacataatatcataataataccaattactttttttatattcttattcttcatttttatacctcctgtatattttgcggtagcattttaaaaacaatatataaaacgtatatataattataatatttaaaagaaaattgcctattgaaaaatgaatagatataatttgttgagtatttatatggatagaataaaatttatatggaaaacctaacaataataaatttttctctatcttttgggttaatggaatatatggaatacacattacgatccctattacaataaacaattccttaatcttaaaatattctttcaaagctttcgcctccctcatacttttagtctatataatcaattagaacatcggaatcaccttcttttctaaaataattactgcatccaaattcaatttatatttttatctcatcatttatctgatttaacaacagtcttctatatatatcattattattaaataattcttcatgtgttccgcttccacatattcttcccttttgtaatacaacaattttatctgcacattttattgtcgaaaatctgtgagctgcaactatagttattctccccaacatcaatcgttctaatgctcgttgaacagatttttcagtacaactatctaaatttgcggttgcctcatctagtagcaatatttctgggtttctaatcatcgcacgtgctatagcaattctttgtttttgtcctcccgacagtttaacaccttgttcaccaacgtctgtattatacccctttggcaatgaactaataaatctattcaactctgccttttctaaagcacttaatacatttttttcattatagctatcaagcccataagttaaattatctaaaatagttcctgacataattggtgattcctgttgaacgtatgctatttttcctctccaatcattcataggtatattcctaacatctattccttcataataaatattccctttgtcttgttcataaaatctctctatcagtgaaaaaatagtagattttccagatccgctttctccaacaattgctaaagtctctcctttttcaatgaaaaaactgatactgcaaagagtattctttctatctgaataccgaaaagaaatattatctaatactaatccacaattgcatttttgatcggaaattataatctcttttttaatctttttctccacgatttcttcatttaaaattttactaattctttccatcgcaccacagcttctattcaattgacctacaaatgccgtcaatcccatacaaggtgttgcaatttggaaaagataatatataattgcaacaaggcttcccgccgataaactcccatttgatactctcacacttccatatccaaatataagaattagtaaaaggaagatcaacattgttgttaaaggttgaactaaagcagttatctttccacctttaatacctatattaaataactctttcgttaataattttcctctttcttcttctttttcttcagctatacatgttttcactaaccgaatattagttaaaacattgttcattctcgcctgatattctcctgtcttattttgaaaatctcttgaaatcctatataattttttatttaaaggactaattgcaaaaactgttattggaactaatccaaccataattgctgccattttccaatcaactgcaaaaattaaaattatagagcctattatagatatagcacctgtaattgcactcaaaaaatcattcgttataaactcactaattaccatagtatcgtttgttatcctgctcattatttcgcctgtttctgttctatcgaaatattcaattggtaaatgcaaaactttactccataaatcatcacgcaattgcataataattttatgagccatccaagacatcaaatacaacactcctaccgaaaatattacttgtagcaaaataataaaagcaatccaacaaatttttttccactcataataatttccactactaatatctatagtattcattactgctataggcatatataatgtacaaaaaacttgactaaatattaaaaatagcaatatacctatgttttttttaagtggcaggtattttcttaacaattcccaaaactttttaacattcaattcgtttttcatctatcttattcccttttcctataaaccagaatatcagaaaaataaatacaaagataaagatatagtccattaaattactatttccttttataatcaaatattctccatctaatacatttcttgtatttgctataatagtttcatacatatcattcttagatcgtaaaacgacatcaactactccaaataccagcgttgcaataagcgaaaatatcatacttgaaatgtataaactattcccacgtaatttacttactttcttacttttaattaaatataaatatacggctgctgttagtaatcctggtacaaacagtactccatatagtgtaaaaatgttcattgatgaatatccccaaaatactgctatgctccctaatactcctaatgcaatttctaaaatccataaaataatatttttcctcatcttttctacctctctttacaaatatatgcaccacaaattatacataaagtgtaccaccataggcgggtataatttttttgtatatatccttaatacagcaagtattatgcctgctggaaatctatacactaaattacttaagaaatctcctcccgtatgtagtgcaaacccaaaaattatagcactgacaataaccacataatattttttacgaaacaactgtgataataagtaaaaaataattcctctcattaaaatttcttcagatatactaacaaatagttgttgacttacaacttcagtaaaaatcttcaagtttccttttgttataaataagaaaacactaaaaatcacagcgctaattaaaaaaatactatctgttataccaatttttgctattcctatttctgagattttaatattatgttgcttttttagtacataaaatggcataatcacaaaactgataacgagtgacaaaatacttgccagctcctccatatttccttgaaaagccaaatttaagaataaaaagcaaaacatacataaaaagttactcagaacaataatacaaactatttctataagtaatttttcttttttatccataacttatatctcctaataagaaaaaggggaagtttaacctccccctcctcttgctgtcataattcttaccagccctttttatttccgtatcctgcacataatcctaatacaggaccaaaagaccagcaacctgcatttgctttcccactcttaaagatcatacttacgtcctcctttctcagaaatttatataattataaaaactatatacttgtatattgtgcaaaaagattatcataaaatcgttttgctgctaagcaataaggatctctttttttcatatcgcctgtaaatagatatgctcgtcccctacatgctccaccacataaatttttgtattcacaaattccacactcttctatatcatctaataatatattatttccttcaaaatcagactcatcaataatatcctttaacctgccatgttttatatttcccattttacattcttggcaatgtagcatatggcacggataaatgtctccgttatatgctatactaatcgttttctttccaaagccacaaccttcccgatatgtaatgccaaccacatctgtaggtgtatctaaaattgtagttccattttctgactctgtaatgttatcaccgacaataacaaaatcatcctcgctgaatttataatcttcaaaaatcttttcgctaaaatccactgtaaatatactgaaactcataaatacacccaatttttttgctaaattttcatattctttcatgaatggaacattcttcttatgtaatgttacaatcaatttaatcggtatcttttcttttagtctttctaccgtatctaacacacgtttcataatacctttatctcttataaatgatgttttgtcatcatatccatcaattgatatgttaagtgcatcaatatacggcaaaaccacttcataatcagagatgttcatcgttccatttgatataacttctaagcttccatttactgtttctttaatatatttacaaatttctcgtaagtcttttctcagaaatggttctccacctgaaattacaatatttttcactccaagtaatgataaatcatcaatgacacatttccattcatcaaaacttaattcatttcttgtattccgattttctacataagaatagcatccaagacaatgtaaattacacgcagaattgacatgtaaatatactgagtcaataccttttatttccttgtaacagcttttcaaaaaatcattttcttccaagaccttataaagttctttctggttatcagatagtgaagaaatctctataagattgctctttaataaatctacgacttcttccccttccctgtctaatccaattaccattccattatttcgatttgctataatagttattcctttgactttgaatgtctttacattattacccaaccagtccatatcttcctccaaattaaatatctttgtttctaaattctctaattccaaaataagtggtaaaaactgctataatagaaaaataaattgctcctattaaaacctgcgtccatactactttttccatcattgtaaaagtattgatataatacaatggggaaaaatatttaaacactttcgtataagaaagtaaattcatcccaatgtagcctatcatataaatccccaagcagactactaatctatactttatggataacatcataatgataaaaattgttattacccaaaaaagatatatggtaataatctgtataatttctattgaaattctttcatcatacaacgctccatttacaattggagttttatcattcattataaaataataacaaaacaatcctacaactactaataatacactaatcacaccagcatacacgcttaatgcctttactttttctatatagattttttttctatcacctactttattcaaataaatccgtaaacttttatcttcaatttcagtccctaatgttctacttgtaatggcaactaaaataatattaaaaataaacatggattgagccatttgaaacatcgccgatataaaattgattgctgtaatatttccatttccgctataagaaactatttctgaaccacttgcaattcctacactatataaaatcggaactaaaatcactgttaaaaaaatccatgtatcttttcttttatacaatttatataattctgttttgtaaactacctgctttctatttatcatatcgtttcctccgccaaaaataattttttcaaattattattttgaattgacattcccacgatataatgcccctcttgtaataatattctttgaatatcaacaatatttttttcatttttaaaaaaaatacaatctttttcacaaagtatagtgggatcttgtaactccaacttttttttctcttctgtgcttatatttccatcaatttttaaaataaaagtcttttctctcactaatttctgatccaaaaccttttttccttttcgaaccatcacaactctgtcacatacttcttccacatcatctaaatcatgactcgaaaataaaacggggattttttcttgatgcgccttatctaaaattacctttttaaataattcctttccaaccggatctaatcctacaaatggttcatcaaatatcaataattccacatctgttaacaggctttgacacaatcccaatctctgtttcatgccaaaagagaatgttttcactttcttttttttgctatcagaaagttctgtcttctgcaatagactttctattaaagtactatttttcttgtcttctgataatattgatagatactgtaaattctcttcggctgtcaaataatccaaaaaactaggctcgattaaaactcctattttatctaatgttttttccttttcactagatattcctttaaaagatatacttccagaagtaggtctaatgaagccacaaatagaatttaataatgttgtctttcctgcaccattttcacctataagtgccactatctctcctggcattattttcatggaaaaatcatccaatgctattttgtttttatatttttttgtcaaattatcaatcgaaagtgcctcattcattatgaccaccgtctttctttgttttgatggtattactatatcatgtttttttaaaattcatcttatctgaaacttaaaataacataaaaagcagggcacaatgccctgctttttatgttattttactggcatcacaattataaatgcctttgtatatttcttatatggctgctcaaaataaatagctgcttcatgtgcatccagaactttttttacaattgcaagtcctaatccactattactactatcatttctcgattgatctcctttaacaaatggttcatacatacacgaactaatatcttttggaatttttttcccatcatccgctataacaagatatatttttctatcatattctgtcagtctaatttcaatagtcgtatcttcatcattatgttgtactgcattattcagtaaatttataattgctcgacgcatttctcttttatcaatgaagatatttctttcctcctcatcaacctccactctcaaaatgtttttatttacctcaatataatggtattgatctgccaaaatatttttcacaaactcagtaaaatccactaattctttgtttaatttgtaatcgactcgaaacatcctattataatcgcttaattgctgaagtaactgctccatttcaacactgctttcaaaacaacgcttcaaatattctatgttcttacttttgctattttctaaatcatttataacagttagtaaatatccttgaacaactgttaaaggtgttcttatatcatgactaatatccgagatcaattgtctcctcaaccgttcttcttcttctttttgttttacagcatcttccatttcttgcgccatacaattaaaagaatttgccatctccacaaattcatactctgctttaaaagatagtctttttttataattcccacttcctaattctttcattgcttcttttaataaattgattggcttggtcaattctacctttattttcttagacacacaaaaaacggttaaacaatacccaattccaaataaaataatacctactatataaatccctaaaaagtgaattgattctgcctctaaaggaatgtttatggttggcgttactcgcaagaaatctatcggaaaaaaagttacctgtattcgctgtctgttctgttcatcataaaactttttaacaatccctctatatttttttccatcaatttcataattaccatttacaatatctataatttctatgctagtgtattttttatattctgctctcggatattgtctttcgtaatctgtattcaatatttcaaaccatgcaccatttctttttaactctgaaatatctatatcttcatatcggctttttccctcacaactgacaatatacttttcctctaatgtattaacaatttttgagttattaaatacacttattacactcgccacgattgcaaatataataacaatcactattgaaaaaaaacaaaagttttttataagcgttacttctagtttcttctttctattttccaaatttatatcctaacccccttactgtaataataaactgaggatttttagaatcttcttctatatagtcccttaatttactaatataaaccattattgtattactatcatataaatactcgtcttcccatacagcttcaaaaatagcctttttagtaaaaacccgttttggattattcatcagtaatttcaaaagtttatattccttatttgtcaaacatattttttcttcatctttatataagcaacattctttacagtccaattttagattctgaaaacagataacttcttcttgaatttcctctgcactaccaaattcataaaatcttctaagttgagcatcgacccttgctaccaactctaatggattaaatggttttgctaaataatcatcagcacctttttgcaatccaataatcttatcttcatctgtacttttagctgatacaataataataggaatattctttttttctcttattgctttcatacactcataaccatttactaatggcaacataatatctaaaataagcaaatcaattttttcttttttagcaatttttattgcattaatgccatcttctgctttaattaaattatatttatcttctaaatgtaaaaccatcaaatctaaaatttctttagaatcttctacaattaaaatagtaaacatatttcacctccattttgtcgcataacagtttttgtacttgaaatgaacttttcttcttttcatatttctataatattgaatttgtttgatataactattatattccatatttacgccaacttcaattcttacaaacaattttatatattcattagccaattaccattttagcacttcatgataattttctcccacaaatatcacttatcaaacaaaatatagtaaatcacatttttcgtagtaaactaatatttgaaatttcaaagcttttacataaaaaatgccgctacaggtttttatcatcacccgtaacggcattttctcttatcttattcagccttttcttcattaccagattttaaatacttcattacctcttccacagtttttccggaagcaatcaatgcgctaaatatctcatctttctgtttatcttcgattttcttcctgaggtcctttgctttcagacgcagttcttttaattctgcctctgttgttttaatctcctgttctacagttactagctgctcctccagagatatattctccatttttttgcgtcttggcatatctgctcctcctaatacgatattttctttattgtatcactctttatcggaaaacaccatatatttttctggacttttcttacctcccgtttcttcgctgctgtttctggcttttggcatattccatctttttattgtattcgtccatgattgcactttccagatctgccttaaattctgcattaactgcatgggcaatgtcctcccgttctccttttgcagaatttttctggggcatacctacaaaggtttttccgttccatgcctggatcacatgaagctgctggattgccaatacgtcctgcagacgaatggcaacatctgccttaaaggtatcgcttccctgtaccggatttacactcagattgtaatacagttcttcctctccccaactgcccttacagtctgttttagtttctgtcatattctcataggcttcccttacagtatccaacacttccttttgaaattccttatcggtaaaccgaaaaaaaggaacatactcccctgtttcgtaatctctgtaacggggcatatcgaggtacagatttcctttcgaggactctttaattgcaagacttttcacacagaaggcctcatcaaaggtaatggtagcaaatcctttcagattattgatctttccttcttcctgtttcaattccggtttatatactctgatattatattccatattgtgatctccttttctactctacttttctttaccgaaccgctgtctggcatggaagatttttggtttcctcctgcacttccacacactcctcctggtccttgatttccagttctgcatcaatctccatctgccgggtaatgttttcttttaaaagctcctcatacgggaaaggctttgcatattcctgctttgcattttttatctcattttcacaggtcttaatttctttttgaacatcttctactgctttatcaagggcattcaagcggttttccatacggaccatattgccggagtcactgctttttaactccacactatattccttctctccctgaaggaacaataccggctccatcatatccttttggacaaatacctgaaatcccttatacataccgacttcgtgcctggtaaaagctgtcacaccttctataatcccacgcaggacttcccctgcttctttatgcttctcatagacttttccctgcagcgtgattgcaaaccccggctgtacttccatagcctggttcctacggtccaaatccatttgaagcgattgcagttctttctccagactttgtatccttttcgggtactggaacgtaaccgcatcctgcaaagcaaaccgtttcccttcatgtgcagcttttaaaattctcagacgtgccacttcattatctacttgtattttttccataatcaggggattttcagaagctaccgctttaatctctgcaaagtttagtacggtttcatctatatcctcacagatccttgccagttcccggctggtaaatacctggctgataaaccgctgttttgtttctacaatgccccataaataagcatcaaaagaaccctttgttacatagcggtaaatattgacttcctcattttcattcccctggcggataatacgcccttcccgctgttcaatatcagagggtttccaggggcagtcgatatgatgtgccgccaccattctggtctggatattggttcctactcccagtttttcggtacttcctataataatccgtttccttccggctctgacatcggaaaacatacggtccctctgttcatctgtttttgcatcatggataaaacagatttcttcctctggaacacctctggtaatcagttcctgttttaaataatcatagacggtaaacgctttcccaggtccgggtgtcccaatatccgaaaaaacaatctgggttcctttctgttcctgggactgtacatattcctggtaaatgttttctactgctttattcagtttggaatccgaatctaccggagcataactgtccaaaagccggggatctgtacccaaaagccttgcttccccggtaatccggagcatattgtcgtcctttggatctaccacacctctatggattgcttctgccctttccaccatttcctgcatacgttctttgacataatcagaggcttccgatactacaaccttatattttccgtcctttaattctggccgcttaatatctagcatatcaggcagaataatgtctgctatttctttaaacaggtgtatcagttccggcagattgataaacttattaaacctggtccgcatccggtaaccagtaccttccggtgccagttccaaagagctggtaacttccccaaacacagaagcccatgcatcaaaatggtaaatccccttttcgtgaagccgcctttcctgcagatataactgcatcacataaagttccaccattgagtttgacagaggggttcccgttgccataatgacgccccttccctgatttttttcgttgatatactggattttcatacgcatatccatagccctctgggaaccgctggaacccagacccgcaacattgttcattttcgtaaaaatttccaagttcttgaacaggtgcgcttcgtctacaaataaggcatctacgcctgtttcttcaaagtacatcacatcatctttgatttcttcattgttcagttcttcgattttctgcaacagttttttctttctgctttccatctgctttatggaccagttctttcctgcttcttcccttgcctggttaatggcttctaccagttgctctgcctgttcttctatcatggctctttgccggtcaggggaaatggcaattctctggaactgcgtatgtccgataataatacagtcataatcccctgttgccattctggcaatcatgcgcctgcggttttccttctgaaaatcttcttttctggtaatcaggatcttcgcatctgggtaggcccgcaaaaattctgcccccatctggaaggtcaggtggttgggaaccgtaagaaggggtttcgttgccagccccagcctcctcatctccatacagatacagatcatttccagagatttaccagtgcctaccgtatgggcaagcaaggtgttccctccacacagcaatgcccttgctacagcatttttctgataaggacgcagttttaacaaagggttcagtcccggcagttttaaataagagccatcatagcttcgttgtctgtcgcagttaaaggtttcattgtaaaaatccacatatttttttctgcgctctggttccttaaaaatccagtcccggaaggcttcttttatctgctccgccttatccctggcaagcatggtttccttccgattaatcacataacgcaccttttccccttcctgcacccggtcccgtatggtcacaatccggctgtttaacagttcctctataatgctgatcgcatccataaatcttgtgccataggtttccctggtacgaatggttcctccaaaaaaatttcccctgtcaatatggtaagacatatctgcatctaagcgctcaatcttgagggcatggccactatgagcgcaatagtttctctggttgctctccgggatttccaaaagctcatatataaactgttcgtaatcctcattttcaatccaggttgttcccagttttacactgatctcaggcgctgtcagttcttttggctgtaccttttccagtgcttccacgttgtctacaaacaagggattgttctgcgcataaatcctagcagtacggagcttctgccgcacatttccgcttaaatactcatctgcggtttcccaccctgcattgggatcttcttcttttgccagtaccgggttctggtagattaacccttttaattcctggagcatttctttcctgtttcccagataaagagagagcatatagggaatatccacccggttatattctgacagactgatatgcaatgcttcctgggcattttccactttgtctatcacatctctggggcgtatggtccttttgtaaaaaatatcggctttggttacgtttttgtcctcatcaaccacttccagggaagatagcagggggtaatcattgtcctgccggaacgccattttatttgtccggtcacagaaatatccatgcgttttcacaaaggcatcatacaaacggtttaactgttcctgtgcctttttcagttcctggtcagaacaattttcctgctgtatctgtaaaatttcacgcaccagaaggcggattttatgcatggcacgtatccggcgcttcacactttcctttgcctgactccggtataaagactccccttcccggtaatatacttcgtcctgtatcaccgtaaacgtataattaggtatctttggggaagcagctaagacgtcctgctcttccttctttttttctgctatgctttcttcataacagtttttaggaagctctccaactgcgtccaaaattcttttttccaggtcaaagtcttccgcttcattgaccagggctgtatatttggaatctttcccgaaaaactgttcaaaccagaccattttcccaagcatcatttccgggtgttccagataatactcatttaccggtaccatgtcttccgtaagccctgtataagtccagattggctccccaatcgaaggctctgcttttttctgaaaaaacaaaaggtcactggtaactgcggtattggcgctctttccaaaagaatctgccggaagccggactgcccctaaaaggtctgcctgttctgccaaattttttctcacagcgctgtcatttttatccaacgtcccttttgaagttaccactgccaaaatgcctcctggccgaaggaggtccatgcttttccggataaaataatcatggactttcaacttcatctttttatatcggggatcatacaaacggaaatccccaaaaggcacgtttcctacaattacatcaaagctgttatcctcaaattccgttttttcaaatcctttaatctggatactggctgaagggtggagcttttgtgcaatccttccgcttatggcatcaatctccacgccataaagctgggatttttgcatactttccggaagaccatgaaaaaagtttccaatccccatagccggttccagaatttttcccttctggaatccaaactgctccagggctttataaacaccccgcacgacttccggcggcgtataaaaagaactgttgacactggcccttgcctgggcgtattcttctgcggtcaacagttccttcaattcctgatattcttttttccactccgggcgtttactgttaaaagcatttggcagcccgccccaccctacataccccgcaagaatttcctgttcttcttttgtggcatttctctcttcctgctccagtgtttttaagatacggattgcccggatatttttctgataccggcttttatccccaccggtaaactgcaaccacccttctgggtaataataatctccggcttcttccttgccttctgtctggacagaggttcttccttcctgccaaagctcttcctttttaagaatttcgctatattcttcccataatgccggaaaccagggaagcagacggtacatattctcctgctgctctaaggtttctgaatcttcggtataggcaatctggtcctcctctgccagatgtgcagtaagcccgccaaactgatcccaggaaagttcctgcagaaaatcttggctttccggcagggtgatcttaatcccattttcctgaatacaaagctcatagcttccatgttctgtccgcaccagataataaggctggccttccggtacttcccgaagcaaaagcatcttcaaaaaatggtctttttcttccggtagctgattggtcgtatagaccagacagagcattttctttaaaatatccgcctggatattctgtttataaaaggctatgccaatctcttctaatgtgattggttccttttcctcaatcacttcctgcactttctctggctgtaaggtttcttcctctgtttcttccccattttctaaggcttcctccgatacagataacaaaggaagataggtccctttttcaatccgtttcccaatttccaaagaaacttcgtcccagtaccagaacgcctccttcatggaagttccctcactccaaaggatataaaaaccactggaaccgctttctgcggtcaggataccgtcttttgtatgggcttctctttttacatctccatacaattcataaagataagcttcccggtctgtttcctctggattgttccggtaaaactcataaattttatatggtatctcctgctccgtcatttccagaagaattttctctttctgccagttttccggctgtgcaggttctatctccccagacagaaaaggaaccgccgaagcagttcctttctctgtatcctcttctgttttttcctgttttatccgatcctgagctgaatgatctcctccataacctgtttctgtgcttccatatccgcctgtatccgaaggttggtcatttccaacgtgttgtaagggtctatcctgtcctccctggtccaggtcttcagaaaactttctgccagtttctcgtggtattcctccgcttctgtctggattttcataagccgctccatcagtttcccggacaggagcatcatttcgtattgtgcctggtccgttctcttcatttcctgtgctgcgatcctgccgtaacggttcagggacgccagcatcttctcctcgctcatcacgccctctaagactggtatctgtacgccattcatttccctgtactggattcctgcgattccttccataatactgcctcctttcaaggtctatgttcttcatggtccttgcaatctgtaacacaatccgcccagataaatgggatactaaccgtcctgtccggtacagaacctcctcattctctgaaaaaccgcagataaaagaaaaatccagggtgtcatctcggataccgcagcggcttttcaccgcataacagacactgtttacaagaaactctgtaatctggttttcttttacctcctgtccctctccgataaggacagccagcttctgcaaggattttaaaatttcatcttcctcttctatcataaaccaaacatttgttcttgtaaaggcgtctaaagaatttttaaactttttttcctgttcgtagatttccgggaacagctcccttgccagcagtctgcggtttgtcccattcacctgccagttccagggccggattccctgtccctttacatcttgaatatcataaacatgggtaactccttccccgaaaattttggaaggaaatactgcaattcctttacttcctctggcaaccggcaaatccatttccagccaggcatcatatcctgcaagaacggacgcatctgggcgctgggcatataccatacaggtatttaagaagtccaactgatacaaacgccccatgcaggaaaggaaatttttccaggaatcctccgactctgaaatccagtgtatggtttcctcatacagttcccgtacttttgtgatatgcttcatctgctgttccttctttcttttacaggtaccagttcttttgcagaaatatcacgataggaaaaatcatctgcccccagcacgattttttctgcataataatctgcttctgcttttgcagttgcctccagttcattcctgccccggtatcttacttttttctccaggacttctgttatggtcacttcatattctttttcgtccatgcttctcctttcttactgcaagcggctgggtcttccatacagcccaatgttcgacggattgaacgggtcattcactactccacgtctgctgttggctgcatgtaccattctgccattaccaacataaattgccacatgggaaatattgcggaactgcccattctgctcataagagtaaaaaatcagatctcccggctccagttcgccttctgtaacttccaacccatgtgttaccataaattctccctgggtagaggcaatcgccggaagggaaatgcctacctcctgatacaaccgctgtaccagggaactgcaatcataatatccttcctcataccggtgttcctgactgtatttgcagcctaccttcgtcagtgccagatttgcaacgtcacttcctacgccaaaggaagggatctcatttcggaattcctcactcatgacttcccttaaaagttcttcttctttttcggtcagctttccaagtgcaatatagtcctcataattcaggttcttgacgtagcagcccttctttgttaccgtaatctcattttcgtccccatctgccagaaacgcttcaaaagtctgatgtccccaggcagacgcagttgcatgatctgcacagaaaacatcaaattgtaccccataccggtcaaatgctccggtatcttctacggtatattcaatcccgttcataatgatcctggttcccatagggacaaaggggttttgtgcatctactgcaatggtatggtccggttttggcatgacaccggaggctgtaggtcctcctgcccactgtccacaacagatactgcactggcaataaccgctggtgacaacatttcccaggctttcccctgcctttatggtagtggttatggtcgtgttttcaaaactgttcatttcatcaaagatttccttcagcttgtccttatgccgctgatccatatccacacctatatccccggttccatacttcaccatataaaccattaaagtatcatagtaattactcacataattcccgtttttctcatggagataggtaactgccccatcttccccattttgtccaagttttgtattaaagtccatgtagtaaccgcttaaaacttctcggacggtagggttctcctcagacggatttggcatgaacgcaccaagtggcgaacagtataagaggaaaaagataatcactacagggattgccaccacaagaagaatactgaacagcggagccaaaagcgccccggcaaactggaccaccttcagcataaacacagaggctttcatctttacaatatcttttgccacctgtgccaaactgtcctgctgcccatttccggtgagcttattgatcatatactggatttttctctgccggactgcctgttttttctgtttctccatctgtttctttttcactgcttttgtttgtctgtaaaactgcttattggtgatcttcccatctgcctgttttacctttaattcctgctctgcctttctataattccgatccttccacatcttttctgccggttttgttgctgtccccatgacataaagggaatcattgacttcctccccgccctctaactgggtcaatatagcagcctctccccggcgtaccccttttatggcagtctgcttcgccagggaagatttttttgtttccgccagctttgcagcctgttccctccgatactgttccttcgcctggaaaccagcagagggctgactgtttggtgctaccccctgtttcatctgatccggctgtaaggttcccggtacagatacggtgcttttggcctttccattttgttttctatcttctgctgctccccggattgctgcctctttcccggcttgctttttcttttccttttgtttttcaaacagcgcttctctgccctgctccggctgtttccctttttctgccccttcttttttctttctctgccctaaaagatcggccaccggcttagaggtaaaagcagctttcttttcctttgcagataaaataggatttttcttatgcaccgtcacctgggcttctttttttaatttcagctccggctctttttctttttttaccttaatctccaaagcagtccccctctccggggtttaattcttctgcctgataccagagcgcctgaaacagatacccctgttccttttctctgggtggtggaccgtactccttttccaattcctgaaaggcttccataaggtttccggaaaattcctggtaatcatcttctgtcaggatatatttttcactgaacagcacctgctccaattcccccacttctaccaaatggtctatgtcttccggggaaagtggcggtcccagtctgtcataagtcttttctttcaggtaggaaaactgataaagttccgtctgctgcggtaaaatcttctccttactgccatcaaagagcaaaaaaatagcttccgcttttaagaaaacggaaacctcagcttgctcaccatattttagtgcctgctccttagaaggaaactccagccagtccggaatacggatttccagcatccaggcttcatactgcagtccaaaagataattgatattttgcgataattcctcctcccttccactacaaatagtcataataaatctcattggtatcttcatgaaaggacaattcatactgtccggggataccaggatcttccatccaccaacggaaaaaagcatctacatctgaccataagcgggaattgcactgccttcctgcagctttccttaactccagcattttagcaaaagcccgccggtaagccctctcataggtcgggaagatgcggaactcccggtatctttgttttcctgccataggacagcctacacagccaacccggtgaaatcccatttcgtaaagagggttcatgggtattttctctgcctggatatactcccagacctgctggtcactccagtcaacaatgggattgcatacgtgtttgccccttgacaggcatgattcaaagagtcgcctggtatcatcattatcattatttaaaataatggcacgtttttttccatttgggacaaagttttcataaatccccctgtttttcctccgctttcggctttctgcccaccggacacctgtggtgataaaacgcccagccccaccattttcttttagaacctcacaacaataccggatagtcctggtaggagggatcattttcatggggatcaggctccacatagttatccgctgccctttatagtaaggtttattgatactacaagttataccggcctgttctgccttctgaaactgttccctcacataataaatagtctgtggggcatctgcagtagtcaggttgtgcatcagttcaaatggcacgccggaacgccgtaccagttccctgcatacggcgctgtcttttcctccactgtccgtcactaccaaaggaagcccataatgttgcagggacatctggctggcagtgcggatacgttctattgctgttttttctaaatccaatttttttcaggagggaagatatcttttacatggccaaaactccgcctcctttcctaattttatctgccgcccctttttggcggctcatatccatttgctgcatacgcttctacggtcataccgtatgactctgcttcctgtcgtatctcttccataacctgttctttgtatgatttatccggacaggcagttgcaaaatcccggatatccggcatacaaggcagctccttccctgtatttaatgcaatcctgctttcccggatataggcaagcatggcttcctgatatgcttttcgtgatgcgtccccctgcgtcagtaaagggactttcttttctatttcctgttcttccagaaccgctgtttccagtttttccaggttgcagaaatactgaagggtaggaagcatctcctccagtacccatctcatttgctgttgttcatgttcccattcttctgttgtcctggcggtctgtttcataagctgctgcccttcttctgtatggagataataatctgcaaatgcttttacatgatccagcagatttccttccccgtcaccaaaatcctggcgcccggtataagacatgacttccccctctgagagaaaacagatttcaaaatgtgttttgtaataacctgccatatctttctcttccactgcctgccgatccagctttccgaacaattctaccgcttgatttaatggcatggcttcttccaatggaatgtccgggtgttcactgatccgcacatacacaaagggtttcaagtccaccggcggaataagttttacctgttccagtgttgtctttagcttgtctgcctgttctttcaactctgatttctgctcaaatatcttgcttcccagccacctgctgtattcctcttttccgtcttgacataaggctttccatataatagcttccttatgttctgcttctttcggataaaaggtatggtaaaaatcagggtcaagatttttttccagttttatcatttcatctgcaaaaacagtagcctccaaggttttctctgttaaaagccctttggtatcaatgacttttgtttccggaagataagcactcagttccctggcagctataaaaacctctgggtattggttttgatcatagatatctctcaaaagatccacatccaactccccgttataaaccagggaaaattccaatggaataccatcttcttcctccacatgaagcccaattccttttcctgcattcaacctttcagaaggaatactctgatagatctttactgcctcttctgcactgtggatatcctccctgtattctccatagcggttaaattccatacattctgccacataatacgttgtcaaacgtccggtggcattctcgcccatctcacctttttccacgtagcaatacctcctttttatgcacaaaaaaagcactaccgtttttagcgataatgctctttgtgttacttcttattttctttttaaatgatacagccatgctcaatcagcttctgctgtctggtcgttaaaatagaatattcaaggctttccctgtcttgatgcaagtaaaaacaaacaggttcccttaatttgctctttttcggaacaagctcaaaggcaaattgcccactgtcaaaccgggcaccatcaaagtatccctgaatgaaccgttcttccgtattcccactatgtagcaattcatcaatcattactacaccgatatagtgtttttcccttagcgaagcctcaatctctgcaaggtaatcaaaaggaggctcgctagtcttcataaccacaagaatattttctttttcttcacttatcacaatcatatcaaagttattcatctaacttactcctttctcctaatttctaaatcacttcataatattcatcaataatcgccaatgctcttttaatcaaatcatgagcaccttttatatccagcatctttgtagtatcaattggtgctgtagggtcatcccaatgttctattggatggcgattgctgttataaaacgtataaatatttccaatatactttacctgctcaggctttgcatttccatatctctctggtttcagcttatattttacacctattttatcaaacatatcaaaatgattttctttgatgtactgcgcatttggtataataccacattctattaatgctatttttaattgtgcttctacaacacgaattgccggctgagccaaatatgttccatcaaacatatcatctgtgacctttaaattatacacagcctgatgaagagatctttccattttcttagacggtagcttatcataagcatttggcatataaaactgaaattcagagcgaacctcgtctttatctatgttaagattatatgtgtcattaaaaattttaggaatttcttctacttctattaattcagtaatatatccaataatagtagaaaataacacttctggtcttccttgcattactactttattatgcttttgataatgtgtcacaactactctatctttacttttgttacattttaaagaaactgcttttccatgagcaatctttttttcatctataattagattgtcttttccaatttcatcaacagcaagtgctataactgttgacaaatcttcatctgaaattccctcaactgtaaaccaaaaatcgcctcttttaactttaggaatcccattaccttctgttaaagcagctttggctaatttatctgcttcttcattataatgatctccagaatgagcttttaccttttgataagaaatttttagaatatctgatttactcttcataaaatttgcatatttctgagtaagtgtattctttgccttccattctccttgagcccacttttcaattccttcataatcataacgaagttctaagttatgataaccattcttaattgcccattgtactgcatacatagcaccaagcatttcaccagcaacatttctaattgctaaagagtccggttcatttccatttcctgattctctaatagtttctcctcttggtgtaagaataatacacccaaaagcatattttcctattttctcatcaaaactaccatctacatatacaactaactggtttgttgtgttctcttctatatctacttttttaatttcttgtatcctattctctaaatagtttttcgcttcctcttctgtttcaaaacctttatactctgctcccggatatccacttaccgactctttacactcattccatgaataaaacaaaccggtttgcttacccttttttacagcataaacttttttctttgccatgtatactccttcaagatttgggattatagcataatacaacctgttcgtcaagaattttatgtttacactttgacgatatttgtctatttgtctatttagctacttttattttctgtttcttattttattatacatgttctgtcaaaaccagtcaatgtatttcactgttgcaataattaatgtaccttctctttctcactctttacataaggaagagattgctctgctgctacttcttccatttgaaagtattctggtagtatgttttcttccctgaaactaaaataccggttctcagccaccacgatatgatccaacacctcaatccccataagattgccggcttctgccaatcgctttgtcacttctatatcatgcctgcttggttctggatcaccggaagggtggttatgtgccaaaatgatactgctggcattggataaaatcgcagatttgaatacttctcttgggtgaaccagtacactatttaacgttcccatacctactacgttgacattaataacctggttttttgtccgaaggtttaaaatacagaacatttcccggtcacaatcttttaaaaaatcctgaaagagttctgccacatcacagggattttttaattctttactactgtatagaggaggttcttccaccaggcgtatacttaccacatctattttatgtgtcttctccatgttcttcctttccaaaacaaatctccagcataattccctccggcagattttttaaaagtctttccaactgttctaaattcatttctatttgatatgtttcagccattctgccacctttcccatgatatacaaaaagagtgcctgataaaagaactgcactctttttgtcctatcctttttctactttaccgacttataatttttgctgttgcctaattttttctcgtctgtcataccttttcctttacagataaaagaaaaagttcctttcagattacattactcctgctttgtctgcaacgccttttcgtgaaggttggtattgaaaagcgcatacagcggattggcttctttttccatacggttatcaaatggaatacaggtatttccatacttaatgatccccgtaccggaaggagaattatctacatattttaattgtgcttctggaattcctgctgcagtggataattcctgactgtctacattggactgctttaacagggcaataaactcactgttccccagcatggtcatggctgtatagttctgcagcatatcaaccaaattttgggtgattcctgtgcatagtcccccttgcttcctcacttttttccagaggctgaacaaaaatttcgcactatactcccggtcaagaaccgtatggaactcatctatataaagccaggttgcccttcctttctttgcgttttctgcaatcctggcactgatattttccagcatgaccagagtggaaatggctcccagctctttccccaggtccctggtaccatagacaatgaaccttgcctgtacattcacattggtatggttattgaaaatatttaaagagccatttacaaacagctccaacgataaagcaatgtcctttgcctcttcttctggctgctccaacaataactcataaaattctgacatggtagggatatgcttttcccttgcctttgcaatgtcgatatacagctttcgtacacaacggtctataatggatttatggcggctgtttagattatccccgtaacattgttcacacagccccagcataaattctcctttatctcggatatatccctgggaatcgtttaaatccagcgcccagacatccatctccaaaggattgatgtaattctttgtataggtagacaggttaatgattgccgcctggtttcccagggcttctgcaatatcaaaatattccagtgtcggatcgatacagataatatcatcatctgttcctaagaacacctgcagcatttccgacttactgaaataggattttccggagccggggacaccgaataccattccatttccatttgccagttttttccggtttccaatgcaaaggttatgagaaacctggttaatgccatagcagacgccggacttttcgtttaattcctgtacattaaagggaagaagggctgcaatatcccttgtgagcatggtccgcattgtgctgatctgccggtttcccactggaagtatggtattcatagcttccctctgctgataatagtgggtttcaatctggcacatgcgtccattgccgatatttttaatggtttcggttacactgtctagctccttcttgtcctctgccatgatcaggaaattaacccctgtataaaacaggttctggtcattttcccgcacgtcgtccataagatttacaatcttctccttctggactttcttgatatgagaaatgtcactggaaaagtcgttatttttattacggactctctgctgctttaaaatatcattttcaatgcccagatatttcttctgaagaaccttatttgccagttcttttggtactggtacaatgcagattgtagtgatgctatgaaccggaagactggtaatctcatttaaaaaggtatccgataaagaagacggatattttttaatgaataatgccctgcattttttccgttccgtttcaaaataacctgggtaaaactgcatataccctggtgaaatatcatttttaggatcaccgcccttttttaacgcctgtctgaaatcaaaggagaattgttcttcttcccctatacggtaaaaattgaaaagtacccgcagccgctcttctgcatttaattcttcaatgcaggaaccaagttctccaaagttctgttttaaggtagcttcaaaagtggcaaaaaatgcttttgcctgttcgtaggatttccgttctacacatacagtcagcagtttttcctgctcaatcccctgccttccatctacaatgcgcttttcaataatctggttataacttccacgcagccagttaaaaccatctcctttttcctggaaaagtacatgctcccggaaatcctgcatatttttattccgattaaaaatggtaataagaaaatatacatcaatggcatttaccgtcttacaatactgctttaaaatccgcatctgttcttctgcacctgcggttacatagttaatatccaaaaaacgatatgtcttggaatatatccccttccctacttcaaaaatgccattttctgcaattctcccaatccccatgacttcctgaagatatttcggggattttactgctttatctgctttttttaactggtcaaacttatctgaaaaaattgacaatctctaatttcctcctttcaggcagatgggaccacaaacacagcagcttccatctgccgctacatgtctgtgtatccctctcctgaaatggagagcaggcgctatttcacgccttgattgaatattctggtcaacggtacatcttataccacaccgctgctgccgcaccaagtacaatcatcactaccgttacgattcccatacggattgccttctttttcaccacgttgacatcaccacctttcttctcttttttctgttcctttttcctttgctgtacttcccgttcttcttcctgacgggtttccatataaatctgtttcagttcctgcaccgattccgtagagccatacaccaaagggcggttaaaaaaggaaaaataaatcatcttccctgcaaactgccagaatgtcagcccatgatagttataaaacccagtcagtgccagaggtacaacaaaaggggttgccacataacagctcaaagtaatcccgattttttcatacaaaagcaggacaatcccagttcctacgcccaatgccaatgccgaaaacaaaaactgttttgctgtaagtcctagaaccagggattctttataatgctgtaggtcctcacttaattcaatctccatacataacctcctgtatctgttttttatctgctctgtcttcgctcttcctgcatggttttctgtaatccatgttgattgcaaaaggcggcaaccccagcctggtcaaacttacgcagctcctccagatgaaatttcaccaccgcgtactgccccataccggattgtgccttccagggaagcaaagttcccagtccatgctcctgaataaattggatattttccttactaaaatcaccgctgatacaggcagttccaggttccaggcaatatccgggaaggtttacggtcaaatctgaaaacggttcccacgccccatcttccttactatacagttccacataaaggttctggttcattgcgtaataatctacccgcaatgccagttcttcggttccatacgcccattgaaaatctgctgttttgatttccttttgaaattctggattttttacttctccccgttcctggtatgcctgctcataggctgcatatccctccgggtccaatttctttaaagtttcttcctgaaattcaaacagtggatattccatacaaccagaacagcaaatttcttcttttaactgtccaagcccgttttttttgacaaattctacgatctgctccagatcatagcctgggagcaaaaaggtctggttcttttccagcggaattcccatatctgtggtcaattcaaaaagtttccatatctcttcctctttttccgtaaacacacaaactttgatgtttttatcagccggataagttgcaacttccagccagacctcatagatctccccattgccaaaatccaggctgagtttttcttcctgttccatttacatatcctcccttcttaccggctcctgctctttgcagacagaagcctttcttttcccttttcaaaatattcttcattaatttcaatgcagattgcattccgttcatttaaaagtgctgcttcccccagggaaaacgaacctgcaaactgatccagtacccactccttttcttctgttacaaatccaaggatctgctgcaaaagttgcactggtttttctgcctgatgaatacgggagtttttccctggcggttcaatgtcaaagaccgttggaagcattcccctggcgcctgacatatagtgggatattcctggctccgccttatcctttttcgcatctgggcgtaaattcctggcttttcctttcgtaaaaaatgcaatctcttccgtatttttagattttcttcccgtattggcaacgaaatttccttttttccaggcgacttttgcataatattcaagtcctgcttctttcgccatttttttcatctgatagaggtgttcataattttccccattttcttccggcatgaactctaccagaaaacacccttttttcaacacccggtatttttcatcaaagtcttcctgcgtatattgaaaacattcataggcggcaaaatcccggtttccccctttcaggctttttttcaggtcataagcatggtctgtaataatggcatctatactgttatcttttaaaaagctcaaatcccttccatttccctgaaccagcatacaagttacctcttctccgtcctgttctttggtaaccgtatagactcctttggctatcctggaaaaaagccccttttctattccctcataaattcttgcccggatactgggttcttttacctcttttacctgttctacacaagccactgcttctttaaggctgaagcattctgcgtcctgaaaatattcaaatagtgtcatctgtatccctttttcctgcacaatcctttcctcctacaatcccagtgccctggaagtcaggttctgcgctccttttacagtgcctaccgtcagcgcaaccgtaaaggtcatttcccccaaataaatcagggttttggcccagtcctcataatctccggtaaaggtcggaagtccggaggaaataaactggttacacaaaaggattgccagcgccattgtgactgcctcaaaaacgacactgataaaatatttcatataggctacaaaggtattgctaagcccccggtttccagccagggtactgctggcaatcgccccaaaaggtacaattaccataattttcaaaaagcggaaataaacattgtacagcaggaagaaaccacagataataacgattaaagacaggaaaacagcaagtatcaggaacacgatactggttccaaatcccaaatctttgatcacttctgcctgcgccgggtcaatggataactccacactctggttttgccccaaatgccccaccaggtttccacaggaagtaaacagggctttcataatggtaatgttataagataccagccactgtgcaatggcaacccggataaacatacggaggattgcttcaaaccgaatttcttcccggatatctaccgactctgcacaaaacccaatgacgaaaaaaaggactaccagggcagagcctatcccaacaaaaaggggttcaatcccttcaatgatcccccagggcccgcctcctttgaacccggtaggggactgtcctaaaagttcaaatacgaggctgacctggttattccaaaatccaaacacgatttccaaaagtgcaaggatcgcctctcctaaattaaacatcacttcacctctcttcttatctgcttatctcaaaaagaagaatggttttagctaattcccaggaaagtaagaacggaggaaatggctgccataataagccctgcaacaattcctttaatggcactgttcatagaagaactgtcctgctgttggtaagcctgtgcaaattccatcacgttttttgccaggataatcacacccaccgcaccgataatactgatcaccagtgtctttaaattcataagcggctgtgttacgtcacttaccccggaagccatgacagtctgggggaacagggaaacagtggcagcgcttactgccaggactcccagtagagattttttcaagcggttctgtttctttctgataacctctttgatcttcatatctttttactccttttcatgtgattgataccgcattacgcaaaaagacagatttttgaaaacctgccctgcgtaatgcaaaaactacaggtttccaaaaatctgccttctttaatccgaggctgtttcttttgtaaattttttacggatttacttcatcttttcagcactgttttttgtatctgccatttgaaggattttatcatacgaaattccagcaccaatggcaagcatgatttctcccaactgttcctcattataaacatggctttctaataattcagaaagtttttcttcctctgtctgtaccggtttttccgttttcttcggcggcctcacctcctctaccgttctcttcttctggttctctttcagctcttcctccgaaaaaatcttcttaggaataggctcataagaaaaaatttcatcaaaagacagttccacaatctgaacatcttctccctgttcctttttcttcttataataatccagggattcttcacttaaaatctgtaccgcctgtttttgggcagccattctgtcatggatataaggcgcagccccgccatcttctgtttccgaaaatctggagtgtgcaaaagtattgtatttcttatcaataataggatcacaacccctgattaacaaaatacactctgagttatccagctttcgggtttcgtccggtgtcaaaagctcacgccccagcacatcataattccgggaactgctcccttgccggcctttggtttccccactgctttttttatcaatggttccttttcccagggactcactgatatacttatgcgtggactgttcattcccaccaagatataccagagaatcacaattacccggtatggtttcccaggttttctcaaacaaagccttgatctgggcaaggttttggataaaaatggtacatgaaatattcctggaacgcatggtactaaggaggctgcagtagtcatctggcaatggcacgttggcaaattcgtccagcatgaaattcacgttaatgggaagttttccattataatggaagtctgcctggtaatacaattcctggaaaatctgggaataaagcataccaattaaaaaggcataactcttatccgaatccggcgttacacaaaaaagtgcagtcttccggtttctgtccccgtcaacaccaatcccaatctcctcaatctccatttcatcatgatccagaatccgcaaaatttgtgggttctgtaacaatcccagccttgcatttgcggaaatgatgatactccttaccgtatctccggcaccccgtaccactttattatactggattaaagcagggtggttgcttcccttttttctctccagtctgcggaaacgccggtctaaatcagaaggggaaccgtctgcatggacttctgcctcattcaagagctgcaaaaccatacggaaattccttttctccatttcacactcctgccacacataaagaaaaatggcctgcaagtacaaagactcggctttctcccagaatggatcactgggctgtgcgtttttcggagtggtattattgatcaggttagtaaccagttttacaatatctgtttcagagcggatatagcggaatgggttatatccgttagactgctccatttccaccaggttcagcacccgtatccggtatccatgcgctttcagcatacctccgcagcatcttaaaatctcccctttgggatctgtaatgatctgggaagccctgcttaactgaaggagattgggtttcaccatgaacaaggtttttccagcgccgcttcctccgattaccaggacatttaggtttctcctggtctttctggtattcatggacagcctgacattctgggataagatcagattattgtgttcatctttatccgcaaactgctttgccacctttttcggatctgcaaaaacagcggtaccaaattcctgtcccggcatatagtttttccggctggttacatacatgaccataccgatcacatatacaaaaatccccagaatgattgcttttaaggaagtttcgttccaataattggcaaacggggctgccatcacctgatccagacggtttaaaaaataattgatatcctttccgggctgataacacacgttcaagagataacctccatagccggaagctatgccaccaataagatacatgccccaggactgtttcttctttttctgaattgctccggttctctacctcctttgcccctgtatggttcttctccctgcttccaggttctgttgtgccttcctgtaattctgctcccttcttctgcgtatcttttcctgctcctgtctggcacgttccctgtgtaccgggtcatagctttccctatataaatcttcccccgaagtttttctaagaaaacggtcctccaggtctaaaattgcatactccttcttcttttccaatcctgcaaaaatcgtcttatggtcattaatccagctaatttccgatttatccagccagataaattcattcttacggtacggaatcctggttttgatatgatgctctgtttcttcatataccagcttctggtctatggtaatggcattcacacctggattgttccgtttctccttttggatacgccgaatgacctgcatcttttcttctgtttcctggctgcttccagtgctgcgtcttttggcttcctcttccccaaacaactgtttccactgctgggaatctaccaattcttcaacctgttccggtgtcctggtcagtgtcaccgtaccttccttccctttttccaaaatcccctgttcttccatgtagcagataatcggccagatctgaagccaggtcatattcagacgggaacggacattactgatcttctccacctggtttttcgccagctcccgcgcaaccagttcacactccttcggctccggcagggcaggcttttttacttcttctaccaactgctctaccttatccggctctgcattttcatagtattcatctaacgtcccaatattggaatgttcaatttttgccatcatggactgaatacggggcgctgcctgggaatggaacaaaatttcactcataccgtccttctcatttaaatccggcaaaatggaatataaaatcccatacttatttgccagggcttttacccgctccaggtcttttgtttcaaaacggaaaacctgtaaatcgcctcccattttcaggagcttttgtacagaagttttccctgacagtttttcctgatccagaacttttttaaataccgcacaaatatcttttacaaactgccagcctgtatttcccattttcagaatgatttctgcgccttcaaaggaaactttaataatctgcgccgcatcttgtatttcactcatgcgctccctcctatcccattgccctgtccttttttactggaacagccgcctttatttttccttctgtaagcatggcttccaggtcatactggatattttcctgttttaagagagcctccagcatgtggtttgctttttccttttcataggtcatatactgaagctgaaaaatataattctcaatctgcaaaatattttccggaacctgaaaaaacggttcaaggtaatgataaagaatacgctctttttcttcctttcctgcatgaggcgcctgtaactgcaaaataattttttctacctcttccatagactccttatgaaaagcaatacggtacaaatcctgtttctgctccctggtaagaaagggctgttccttttcggcagtttccaaaagggaaaatgtttttaccacatgttcaagttctgccatttacacacccgccttccgtttccgcatcaaaaggataatttcccgcatttttttcattctctctggtgaagggctgttctccatcacctgaagaatttctgcatctgccagcccactttctacgcactggcggatttcttccaactgttctgcggacaggttatattccagaattttctccacaacacttttgggtacttttttcccaagcatggcaatcccaagcagccggtgcttacttttttgtagcccttccgctgtttgtatgcttttttcttccaataccacttttgtttccctggaagcagcttctgttttttccctgtatttttctgcttcttttttcagatcctgaatttcctgctctttctttgccagcttttcttttaattcctgtatgtttttatctttatattgcaggttctcatacaggtctttaatctcctggtttttctcttcaacaacatgctcctttaccagagaggacaaggctgtaaaacggtcattgctttcccgaaactgctgaatggattgttccatgatccccataagatttttcatataagaacgcatttcttcatctttcggaacttctttttttgcctttgactcttccagttgtatccgcatggtccgcatacggctggccggcagttcatttccagcataggttttcacctcttccagatccagcccgttttttaagccctctacgatttcccgtacctggaactggttataatttccttcacataaaaagtcgatttccccaatcccttccataagccctatgatgattgctttcatcaccggggcttcctggttactcttaactaccttctggatatccgaaacaggaagaccaaaatccagccccatagaaactgcgtccatctgttcttcttttaaaactttccggcattcttccagataccgttgtccttctactgtcatttaccctccttttcctctgcccctcgcagacggtttcctattcttttccttctgctgtgcttccaacttttctttttcttctgctttttcatgcagacgctctgcaatccttttttcttttaagatttttttccgttcaatccgcaaacgctcctctttctcaaagaaataagcgtctgtctgttctgcctcagacaaggaatatcccatttcttttaactgcccaagaaggttttggtatgtctggtggtcttgaaaaaattcctgatacccttcctgataaagttttgcttccatctgtttttcctgcagcttattgagaagcagaagcatttcctcataaggaaccatttcttttcgtagctgctttcttgccctgctgttttcccaaagctgttcctttgttgcatcagaaatggctttcaactgcgccttatcctgtatgcgataagctgccagaaaatcaaattcctcctgcaattttttcaattcatggattgctgccctgtatttccaggttttagagtctgccattggtttcccctgccggtacctgcgaagaaaacattccttctggtatctggtcaaatgccgctcccggtatgggataaacacatacgtccattctaccggtatctcctctccggtcatttccgggattggaaggcgtcccaaacgctgccgaagcctttcctctgtatattcttcccctagctggtcaagccgccttgccattcctgctccgggttcccgaacagaaaggcgctttctcccccgcaactcatatcccatgctggaaagattttcaagaaattcctcataagaacctgcgtcctgtaatgcctggtccacatctcttctgatccgcctgtcccgttcagaaagagatttttcttcctgtcctttttgtttgcgtttttcctttgcttcttccagatccagcacagataaaccatgctccctgcatatccggttggtcagaggctgaatgatgttttcccaatccccgtttttataatcgtatttatatcccgtagtacagcgtactgaattaaaaataatgtgcccatgaatatggtccgtatcattatggactgcataaaccgcttcaaaatccttcccaagaaattctgtcacaaactctcctaccacttggaaggcttcttcttccgaaacctcatcttcctcaaacgaaagaatgaaatggtagccctgccttttatccagctttccaaaatgacgtttggtatctaccatctgggataatgcctgttcaggaatacagttatgtccacagacatagcggccatgttctgttttctccgggttcataatatagcgaagaccgtttgccagatgtttcgctggataacccatttttgcctgtttcatgtgcaggcactttgtaattgccataacctacagcctttcctgcacctggcttaccagtgtttttatctgcttcaaaaacacatacagacggtgtttatcttccctggaataaagggcgctgttattgttatgggtaatctggttgatgtttacgccaatccggttgatttcctggttcatgcgttccagttcctgacggatttccgggtaatccctgggacggttggtaatcagcatacgaaggtactgggaatcggaaagccccatcttttctgcctgtttttgtaactcttccaactcccatgagtacagccggatttcttttctgcatttcattgtttcttttttcatgctccccctttccttatctttatcacatatttcatctaccgatttctactccaacgctatctgctgtcaactcctaagacctgctatcggtcaccatataacttcccggtgtccggactggctatgccagtcctctgcaagatacggattttgccgtacaaaatcccatcttgttagggggatgccccctaataccccggataaaatagatagcaaaacgcaggtactgatagcagtcctgcgtcctatatacagaaaaaccgatagcagttccaaacatctgctatcggtttttctgtttccttttcctgtttctgctaacagaaacatatttttgttagcaaacctgtcagccttctgcatctgatttgctaacagttttcctattctgctaccacattttttcaatgtcagcatgatttctggtttgcccaattgaatgtcaacatggaagatgcagccgtttcataatctcttcatacacttcccaactgtcatcatggcttttcacatattcccgtacttcttttcttaccatagaaggaacaccttctaaaaagctgctcacccacctggcacgctcttccagataatactctgtatcacagtatagatctttatcccagccatcatggattttttccaagactgattcctgcacctgaaaattctctgcatagcggttgaaaaacgcaagtgcaaaggccgggaagccaatatactctgccagataatacagcctttggaaatcatcatagctcatgggtttcctgcctaaaattttctcccggtcctttgggctgcacagatatagatacgccattttttccagttcttttgtttccataattttcctcctccattcagatgccagtgtctgtttttattgtactccttcctattaccagaaacaaggatatagaaagcataccagaaacatctgttttctatctgtacgggaagtttccttttcttctgtaatatctctctttccaacaagtacggggagatccccggtggactgtttgccgctttaggtttcttttatggaattattggtttacctgttcttctaaacgttccaatgccttttcaaacgctccaatcccactgaaaaaggaagaaagccgaatatcttcaaacagataaggcatagccttatgcagttccaggaaaatataatacagtacatcaacaacaatggaatttccggcctgtttataaagctggctgttgcttacgcctgcttcttttgctttccaaaaatcggtatcggaaaatcccataagccggaagcactccaaaggtgtcagtctccggatacggaccagggactccagacggtgtatcccatttgttgtcgtaagcgtagggcagatattcccatgctcctgtacccttccccgtttttctacagacggatagctaagattcgcaacaccgtccttccaacattcttcatatcctttttgcgtcttttggcgtaccagaatgatgttgtctttttgaacagaagtaagggtatggcagacttctgtttttcccagttccaatgtctgtacaatcctgccctctttatcataccttccccggattgctccaggatgtttttctacgatctttggctggtcatgccctgccagaaccgtaccacagcttccaaggggtgaataaaccgttccacttgaaccataaccggtatggatatcccccacttgaagtattttcggctgctgcccgccaccgccgccagtagtcactgtaggacagcatccgtctggaagataaacccttcccgtctgttcaaattcccctttaatagtcccagcccttttcatccggttttcccggaaaatcttcaggcttttttcatccggttcaaacaaaagcgcttttctttcttccatatcttcaagcagccggcgtactttttcctgggacaggtagtatttttcatctaccgtatcctccagaacatccatgaggcaccggaaagactttagtggttccggaaaatgaaattttccattatccatttccttctgtatcaggatcagataaaccctttccctgttttggggtattccgtaatgcttcgcattgaggacactccaataggtatggtatccatattcatgcagttcttcttcaaaaagccggaatgtagtatcccggaatttttttcctacgatgttttttacattttcataaattccccataccggcttgacgccccgtatcatgcggagccattccaccagaagggaagagcgtgtcttgtcaatatcatgggaaccacacatgctgcaggtatccctttgggaataatgcacctgcagggggttatactcacgcccacagttccggcatttccagacagcccctgcctgcttgcctgccagggaaaaatcctggcaggggcttccgccgcagatcatgttaaacggctcaatctctctttcgtccacttttgtaatatctcccagattcaatgtttcacttgtaccatgaatcgcacaataactctttgctgcatatttatcaaactcacaaaaatttaccaaactatatttcattcctcatgtttcatgaggtgtagctacacattttacctaggattactcacttatttcctcctgtctcctaaatttttatagttttaatgagaaatccacagctacaaacgaaatatccatctggcattatcttacaatcatagaatcacccctttccgtatccagatagtctgcccttctgtcacgaaccctgttggtctgcaccacctcctttccatcccccatttcagcagccacctcttatctcatgggtttctcctgcttttggggattttccatttcttttgttctttcttcccctgccaattttagttctctggtataactgtcatacacgtacacctcgtttgataaaaagtctgtttcgacactttcctgggaggcattgacctcctggatcattgttttaagtgcttcgagtgtatgtctatgtgtatctatagccatacactcatggatattggcagggataatataagttttccctccaaaaaaatctgcaatttcatccatgatatccttattcagaatagaagcagctccccagtcttctttcttgttcgtgatacagtacatctcctgttcatggggaatctctgtatcccctgtatggaaaattttgctaaggggaaatacttttatctgttccttaaaagaagatgcgttgatgatctcatccaaaaattgttttggttcgatctgatggtatttgaaatactcttccggcaattttgcacttaatgttgtaccgggaatgttccatcggaatacgatctccagattttcaaacgggatatgtgcaagcacagatccatcttgcagactttccctagggacaaaagtgggaatgatatcttctttttttgcttcaaataccggaatattttttgcaaactgtattttatcttctgcctcatggatggtccctgtataattttctataatatagggaaggcttattccctcttcatacatacggtaaaaatcttctgcataggtcgtgatccctacattgctcccttccggggaaaatataattccctgtttcggctggccatttttatataccatacggaaatctatatccccttgtaattcttctgaggcgatctccagaatctgctttttcaattcttcataaaagatatcaaactccatgttttccaccctttcccaatccttttttcctgattttttccagtaccctggacacatacacctgctttggtatccccatacggtatccctgccgttcatagctctcctcgatgaacggaatccgcatatgcccatgcagcttcctcttatataaccactgcacgatttcttctatttcagcttcgcattcatctatctcccatttttttaaactttcctcatcatagctattatccaaaagaataccctcctatcttgcctgtgctatctggtacggtgctatgttcctgtatcctacaggattttctgtcttttgtatttctgtccgttttctctctgtaaaagatgttcttcccttttgtatatggaaagaaagctcctggttttcctttgcatactgcaaaaaagcgttataatcttttcccacaggcggaagacgcacgaagacctcatagcccataagagtatatttttttgccagtttttttacagcttttcttcctggtatgtcattatccagacagaattgtatgttcctgatatgcggataatcttttaaaaatttttccagaggaccgtctgaaagcattccaagcaccaggatattcgtctggcaatctccccgtagctccatatctgacatggcatcaatcgctgcctcatatacatggagcgtatcactatgcgtattgaccagattaaccccataggttttgtcgttcccaggaacatctcccttaaagggcttcccatatttatccagggttcccctctgactggcaaaacgtgggacaccttccgggtcctttcccacaaaaaccaggttgtgataatttccgctctcatacaaaagccccttttttatccagaagtcgatcaccttctttgacagcttccgctgcttcataaggtatccatataaccggcggctggtttccgactttggtggaagtacaaagggttccttcgggctctcttttttctgctttgtttcttctggctttccaggctgtctttcctgttgggctttttgcatggttccggtacggatatatccggaaaactcaagcaaatactttaccgcctccacaaaatccatgcttttgaaatattccaggaagtcaatggtactgccccctaccccctggctaaaccggcaccaggaggaccggttgaagatcataaccgaatccattcccacagcctggtaaaatcttcctttccgtttcaatggaatccctacctgctctgctaagtccactaaatccactgccttcgcaatctgaatctcttcagacgtaaattttcccatgctgcacctcttcatatttcatatccagataatgtgacatttccgggtgcaaggcttcaaatgcagccagatatcggaaactggaactgttttctccctgcccggtacaaaattcccgtaagctttttttcacatactgtgctggctggttacaccagcggcttaggttgatatacattcctttataagtttccggtgcccgtagccatgcctcgtaccgcatgaggtacgcaagacatccatattgcatcagaatctttatccgttcaaaaacatcccggatatctgccgcccagaaatctggcagccaggtgccatcccagtcatagccgcatagcacatatagcttgaccttgtgataagaaataggaatcacctcccgcagaagttccagttttctttcaatgagttctttatctttgatatggtcaaaggcaaagaccataccattatccagcttcccagatgccagaagttcaatctgttttttttgcatgatacgcagatccagcccttgccggaactgaaaccgtctgcccgtttccagaacactggaaaagattttttcccaccctgcgtaagcaaaaaagttatcatccagaaaacacaatttctttctggaggggtcataaaattcttccaatggacttgctgctactacaccgctactattttggtttacacagaaactgcactttcggaaacatccccttgtgaggaagccaatggaataatctgtataaaactcaaactctttcttctgtttttttcctgtactgttgtcatttaccatccggtcatacaagtgataatccggtgtatggtgttcaatcgcttctggaagtaccggtgctttatcgtaaaaaaatccagtccctccataaagggttgtttccctcgtcagaatatgttccggcacgaaggtatccgtaaaaacctttgatacatagagccggtcatattctccaacctggctgtaatccaaaagaagctctgtttcaaatccctgctccttccaataagcggagagtttcatacatgccaagttgggaaaacggtgtcttttccggtataaaaggtctgcatctatgatcccaatcctcaacgcctgctcctttccatacggatacttccggttttctgtttctggtaggcagcttcctttctttcttccacttctttttccctgcttcttgcaggacaataggatttaccatttgcctccatgatttctgcaaactcacagatatggaacacattcccccctacctttgtatgatatccgtcaagatagatacaaacctgttctttcctttttccgtctggggatatgatctctatagattcaccgtctgctatggtaaacagggtatggtaatggctgtcaataaaccgtattctttttttctcttccatgcttctcacctcacacttccaaaagaaaggacagccgtagctgccctttccccaatttaaaaactgatttttatttcctatgcctttttatctttttttctgtaatagagcaaacctgctaccatacctgcacttgcaccaagagccagcaggggcaggaaccagtttgtatcatcgcccgtttttggtcctggttttacggtacctggcgtttctggtatttttttattctggatctcttttaccacttcaatgactggtgttttatcattctgataggtgaatacgatttcccactcttcttccgtcttctgatatccatttaaggcggcggtttctttcagtacataggtgatcggttctttgaagacaccattttcataagatccaattggaagtagttctgaaactgcttttccatcttttccagtcttcaaacgtcctacttcttttccggtttccttttccagcagaacaaattctactccttccagagtcgctttgctgtctgcatccgtttttacgataaccagttgtcccatagcacgctcatcttccatttttactttctggatttctccagtttcttccactgtaaactccacatcattggctacaatatatccatcaactgccgcctcttcatgcagggtataagttcctaccggaaggtactcaatcagatgttcttctcctgtggtccaggactctacaacttccccttcctgatccaggatctgcagcttagccccttcaatctccttaccatctgtaatatctgttttagagatagaaacctttgtatggtcgtccttcattttcactttttgtacttccccagtttcttccacaacaaattttacatcttccgcccggacatatccctgttctgtaggcgcctgttcttcatgcagtatatattcccctggtgccagtgcgtagactacatgagcttctttttttgacacccactcttctaccacttttccttcctgatccaggatctgcattttggccccttcaatctcctgtccgccggttaaatctactttcgtaaattctgtaatggtcggctgattggaaatttcttctgaaaaagcgagaagttcaagggtctggtctgtataagacgcatcaaaagaatacacttcatcatttggcaggtatccaggtttatgctctacttccttgatgtaatattttccatggggaagatcagagtgaaataccagcttgccctctttgtcggttgttcccagctcgatcaaggcatctttttctacaatcacttcccctaccgcattttggatagactcctgtgcatacagtccgaatcctactccttccagcggttttccggtttttgcgtcttttttcagaaggctcagggaaattttctgtcgctgattgataagttccatcgttacataatcaactgctacttcctggcccttatatgcaatttcaaattcttttgcttctggatcaagaacacagttctgtcctgctttttcttccactacataatattttccgataggaaggttattaagaacggctttcccttctttatctgtcaccataagggctaccaaagtatctttttcatatttcacaatacggtttccagcttcatccttctgtccgtcaggggtataaatggtttctcttgcataaatggcaaattctgcagcttccatgttcccctcttcgtagtcaaattcatagcccttctctttttccatgacttcttccccagtgaagaaactgcttacctggtttacgaaaccagccacaccgtttttcatctttgttaggaactttccttctactttggaagcaccagaaagtttttctccttttttgtggattgtaaggcttcctacggcttcatcattatactgttcaatgacaacaataaatttaccggtttcctcttctacctggtgtacggtatccgcatctacagtaatcgtgatcggtactttctttgcttcctggtaagttcccccgtctgctgtttcattcaacggaacttcctttccatcttttaagagagcattttcaaatcctatctgtacatagttttcaggtgcttctatctcttcgattcggtaagtaccgcactttaactgttccggtgtgatcaggtatccctcttcgtttgtcctgaacacagataccacttcttttttcgggtatcttacgatcatttccacatatttttctgcttccacatcaaaaattttataagctgcactgttatccagtacgggcttctgtgtctgggcatcttttttcacaatcttgaagtaatactgcaaaggtcggtcatcaaacacacgccatacctgaggttccctgctgtcttctgaaatctgcacgataaatgggcggattccttttaaattttccggaacagtagattcaaacaccacatacgttccataaggaagctctgggctcttcaaatatcctttcttatcggtaaacagctctggtactgtgatttttttaccattttcccaataagaagcggtttcatctttgctgtaatcatatgtgataaagtcctccggtgtataataagagccatttccaggcttcaggctgccatcctttacgccagacaattcactgatgaggaataccttgaatcctgccccttccaccagttctgtttctgtctgttccccatcttctgaaatcttgataagctgaaaggcctgtttctttacagtttcctttacagtcacctcccggtgtacaatctgtacttcctgtccctcatacgaaacctctacgggatactctgtttcatctaacagatacccttctgccggctctatttcttttacgaaataatttccaagatacaggtttttgaaatctacggttccttcactagaaatcgtaccctgcgctacaagttccccttttttatggacaatcccatctttcttatttgggtgttcaatatcttgtgcagcatataatccgtattttgcccctactaaggttgcgtcaccctgggaaataaatccctgggaatcctggtcaatcttacttacatgaacttctccccgtacttcctcatttttaaaatcatgggaaaaagtatatgtgtaggtgctgtcgtctttatattcatagaagaaacgatacacctcatctgtcatataatacttatctggtgcctggatttccctcacgctgtaatggaaattcaaaggaatatctgcatggaacacagctattccttccctgtcggaaacagcacgttccaccaggcttcctttttctacaagaacctttccgtctgctgctgtcaggtcttcttctgcatacaacccaaaggtcgcaccttccagggtaacgtcatcatgttccgattttttcactacatttacggaaatctccggtcttgcattggtaaaaatggtttccccctgggataaatctacattctgtcctgcataggacaaggttacaaactgggtacgttcctgttctgttttcccaatcaccaaattttccggtgctttctgttctacaaccttatattttccaagatacagctctttggaaacagcacttccatcttccccggttgtcagactttctaccagatcccctgctttatgcaccttcgtcactttatcctggctgtaaatatcctctgccgcataaatgttatattctgcccctgcaaagtccgcatttccatatacaaaagtcaggtttccctcttctccggttactccggtcagaacctcaccttttttacggattgtgatttttcctttctgttcctcattcgtcactgcaacagaagttgtttttcctgtttccagcttcacattaaaagactctgtattcagcttataaccttctggaacagaaatttcttttaaatataccgtatcctgggtttttggaaattcaacctcggaagtaccattgctgtctgttgccggcatttctataagaaggtttttacatgcactgtccagataaataccaaaaacagcaccggaaaggtttaccttactgttgttatccttttttgtcacctttacccttgccagatctaaccacttcactgtaaattctacagaagcactttcctcttcaaaaaatgccccatatccaatatcctgtgagccagagccggtagataataccaatgtcttccactgcgttcccatctgtcctttcagcttgccgctgttccatgtaccggttactgtttttggggcactgaaatagaaagtggtgtcccctttgatctttacagtccctgtctgttttgtacttccactgtggtaggtcacattgtctggcatttttaaagtaatatagtttctatggtcgccttttaagctaaattccccggtacgctgctcattaccgctttcataagcctttgcttcttttggggataatgtgattgctgctgtcggaggtgcttccaggctgtaaatatgctggatatatccccatacaccgcttgccttgatatcttcaaaagtacagccataaaatccgtccatgccacaatacgaatatgcagcagctaaatgcgtaaaaatatactttgttttccagtcaaaagacggcatatactccccggtaatgtccccaggaccgccatatccataatagaggactttctgtaattccgggttgctttcaaactcattggccacataatccgaagttggtggagaagctttcatggattccaggcagtacgccacatgtccatttaccgtaaaataggaagtggaataattccctacacttgacgggtaagggattttctccccctgtaccagatgtacattgcttcctttttccctttccattgctgccggaacaacggataagtacattcccttatcctcttctggtgtaaggtcaattaactctgttcctgcatctggcatttccggttcttcggccagtacctccggtatctctggctcagggtccgcctcaccgtcctcatcggagccgctttctgtatgctggctgctttccccctgggattgctgtgtgctgttttcccttgcttctaccacaatccttctcataatctgataagaggggtttccgcttaacggatcaacacgataaaatgcctggtaagcccctggggcgttaaagtcaaagggattgccagattccccttcggctttcaggaacgttacctctactttttcatcatttttctggaaaccagtatcatcggattccgggtcaaatgattctcctgtttttatggtaagatcctctgcatacaccagttcttcttctgtcagttgattctttatctcttccagttccggtaatgtatccaaagcagttttctcctgttttgcttctgctttctgtatccggctattttccccagactgcccggaagccagtgccgttatccctgtattgagtaatgtcgaacagctaagaagaagtgccagtgtcccagccagcagccttttcttttttcctttcatcataactttgctccttttcatttttttcgtcaaaaaaagcaggccacacaagcctgctttccattttctatcttcttttttgcatcttttgtgtacggtctgtcccgtatccaatgcaaccgccattcccctttctattccctgtttcctgcatggaacactgccaaaacaagctgcagaaccagcagaaacaagcataatactaatttttctgtcagatacagcagtttccccactgcgatcaaaatcccttttacaacttcccatacggttcttcctactgccatacctttttcctccttttactcttcaaatgccccataaaattccgcaaatcgtaaatctttttccatacaggcttcttccttttcactgtttcctgctatctgtccgctgtcagccagttccccctgaaatgtttctgctaatacgttcctgttagcaaaggcttctttttgtgcctgggaaacggcatcttttacgattttacaaaattgttctttctggttctccagaagggtatttaatagtttcatctgctgtacatcttcttcctgctgcaggtattttgcaaaataaacgattgcttctgctatgaaatcgtctttcgtcttgaaaatatctttgttatactccttcagatatcggtatgcctgatgatgtactggcctgtttttatacagccgcagtgaagtagtatatactttttccgtatccataagccttcacttcctatcatgccgtccgcattttcctctgttttgcccggataatgctttttactgcttcttcacagccccttgcattggcatgtatatccgtcacaaactgtacatcttttccctcattagctccaaaatggtccacaatggaagaaccacctcccatgaataccattttggtcaggtccagattataatgatttgcctgtatgataccataaatttcctctgcataggatttcaaacagtttataatcacttcctgatactgcttcgggcagtcatagcttcctgtcctcataaatgcttctgtaatgtatgccggtacccctgcccctgtttttgcaatggcttcctcattcacttttccgatacagtacaacgccgccttatccgaaatcgaatacttcccgtccggcattccgtcaacaaactctaccaggtcggtagtacctccgccaatatccactaaaaggcaataaccaggaacagcttctaaaagcgtatggatcaccacatgcccctgcataaagacaaacacattttccaaggacacatgatagtgaaccccttcatagcggaaatgcagttcctttgcctttaacagatatttcttgaaactttccttctgctgctgaaaccttctgggcggcagggcagctcccattttcacagaagcatctgtcaatccccgataccgcatctcctgtgccagggcagccatggtaagaagataatagttttcattttctgttttatccacacactctttttccggtactttcccacccacataataaaactggttctgatattccagaatatgttccagactgtctggctttgcctgcaagggctggattgctgctgaaaatacggtatttgctgttttcatgttacggtttccatggtctattccaataatcattttattttccactttcttatcctcctgaattttatattttgtatctttccactttttcatctgttcactcttctgcaaatggctccagcatctcactgatttctttttggaataacctctgcagccggacaaccacatggacatttggtttttgctgtccatattcaatcctctgatatgtccgaagactgatacccaggacagatgcaagttctatctgcgtatatccatgggctgtcctgaatttctttaattttgtaacttcctatcacactccttatgtctgagggatagcttcatgataagcaaacagattagatatatagctgtttgccgtcaatgtggcattatataaagcagtcagtaacactgccctgatattatttgctttttttgtacactgtttaatagaatccatcacatactccacagagaatttatccagttttttatacattccctgcacaacactaagagggcgttcttcctgatttacccgtatcgtctttgcgttggaggtcaaaacatctacagcaagccctacaatctcattgagcagctttctgtcataaggtctgtctatccatatcgcatcataatcaatctgatctttgaactgtttttctgctatctgataggataagataggattatcttcatattcattcataatctctgttgtattctttggagtattctctactgtagtctttgtagtaatctctgtatttgtctgcccacaataggtttcaggtatctcttttggtgtccaaggctctgttttcctaagagggtatgctccctctttgaatggggttaccctctcactttgaaaagggacagccctctctcctatgaaatgaacctcctcgtctatgtttgtagagggaatttgttcttccattttcgatttccctctgccgttttcaaaggaagacaaaactgcacctgtttcttctggataagtcaattcttttagcctgtctacgatcaattccagatacaggacattattgaccacaatcccattcatggatatagttctaaatactctccttaccacacccagtttttccaaaaataccactgcatttgttgcttcttttttggaaattccgaactgctcactgatctgctgataacttcgctgaagaaggtcagacttaaatttttttcttaccccgattacctgcccggttccttcatccctgatttctgtaggcttataccaatacacaatatctgccagtatgataatagccgtcagatttggctttccgctttctctgataatcgtccgataccatacctgaggaatgatatttccagatatattcagttttgcattttcgtctacaatttcatttcctgtgctgtatatacctccattcatatgttatcctcactttcccatttttctttgtacttatataaaactctcattttttcatctgcttttttggcaacaactaagcacgcatacaaaggaaacagaaaaataagtaaaccaattattatgattacttttatcattgctccatcctcccatgaaaaaaggactaagccagctaacagaatcacttttaactaacctagtccatatctttttttacaatatattgcaaccgaatggtctttcacaaacttgaccgcctgtgagaatggatattttaacaggaccagtagcaaagggtttctatcattaaaagtccctgccacctaatttccattatgcgaaattcattcccggtctatgatatttctaccatttatggtataatagaaaaaagactaaattggcgtgaacccttaatttataaggaatctgctaacttagtcttattttaacatgaccaccacttccagaggttccaacaatcgctacaaactcccctttttctacttccaggtttataccatcaagagccctgacttctgtttctccctgcccatatatttttcgtaaatttactgcttttaatatattcatgccatcctcccatcaaaaaagcctgtattgatctttacaatacagactttatcataacaatgtctccatctggtttctgaaatgtcacagttttgatactattccttctttgctatcggaagaaacacagaaaatgtagaaccctttcctctctttgatgtcacttttatataccccttttgtgcctgaatgatctctcttgcaaggaataagccaattcctactcctggctggtctgccactgacagactccgataaaaccttccaaatatctttggtatttcttctttttctattccaatgccatcatcaatgatatcaatctttacaaaaaaagaatactgctcgacttttatctgaacatttcccccacatgctgtgtatttaatcgcattgtctacaatatttccgagtgcctccacggtccattttgcatcacacatagcatgtaaatccgtgtcaaatagactcagggaaatatccttctccattgcttttacattaaactgctgctgtacggatgcaaacatctgtgcaatagcagtatcctccggatgtactgctataattccgctctccattcgtgataattggaccagtgattgtatcagaaaatccaatttctccgtctgctccaaaatggtagctatctcctcttgattttcattactcacttcagagagtatttctccatagactttcagatttgaaatgggagtcagtgtctgatgcgcaatatctgaaataagtttttgtatcacttctttctgttcctgttgatttttttttgccagaaaactactgtctatatattgtttcatgctgttttcaagagcagaatacttttcttctgatatttctgtccgttccagttctccatctattgcacaatccagcattcgctgcagccggttaaaaagctttttttctttctgataaaaaaagctgtaccaaaaaactccgctcaggacaaatataactacaatcaacataattgtttctatcatccattcaccgcccatgtataaccaattccataaaccgtcttgatatattcaggcttctgcatatcatcttctaatttgtctctgaggcgtttgattgcaacagtcagagcatgagcatccacaaactctatatctccctgccatacctcgtcaatcagatattcccgtttcaatacttttcctctgttttcacacagcactctaagtagcttttgttctgtcttactaagttcaataggttctccatctttgaaaaattccattttatcgaaatagaactcaaatccatcaagctccatagaattcttagctgctgcctctttatttctaagctgcacagacactcttgcacgcaaaaccatcaagctaaacggtttcgtaatataatcatttgccccagcttccaatcctgttacaatatctacttccatgttatttactgtaagcagaataatcggcacccaactatttttccttatttctcttacaaaatcaatcccattcccatccggcaaattcacatctaataaaaccaatgtgatatcttcctttttcaagatttctctagcttcctgcaaagttctgcactgataaaagaaataagcatcattctttaaagccagacggattccatcatttaattttttgtcatcttcaacaatcagtaacttttcactcatattttctctgctttcttacaaattacgctaattgtatcattgtcagttttataaatcaaatcattaaatcaaaatctccggcagaatttatcttataaacagcaaaaaactcccgaaggagctttccacgttttaaatgtacactaattctcttaacacaacctcttctgcatcatttcatatttcccatgaagaatgttgtaaatttagtactatccacaacgataacaggtaatttaattattcgtattttttcccgataatgtaaatcgaaactaccataccgcctaatatcataattaagaaaattttattcaaaatatcccataaagctatattgaaacaattgattattataatacctgcaagaggatatagaacaacagttgcaagtgtccatatttttaaagttgtgcagatgtatatccaatttccattgttaaaagataaaccaactagatgtattctaaaaattccttgtgaaacataatttatcttgttggcatcataatatgttggtaatatgtcttttgcaaagaaacaaaaccatgcaccaaataaaagcattcccccggtaaccagcaatatatcccctttcgtctcagctaatgaacttccagatacaactaacataataatttctgtaatagatataaaaaaacataacaaatatgctaatatccagttttttctatgctgatgaatagaattcctaacagccatatcgagagagcctactaccaattcctcgacttcttttgtatcaatatttttctgtgtatctattttttctccacgtaacaattctgtaacggtaacatctaatatatcagctattggtatgagtaatacgacattaggcatactaagaccacgttcccatttgctgaccgttttatctgatacatataatttttcagccaaatccttttgagttaaattctttttctttcttaattcggttacaaataaaccgaatttttcattactaatctgatacatgcatccacctcctgcacacatattataatgggagtacgcataaatcaatcgactagcagtagaattgcagaatattagcacaaatatatcaaataatctccccattataattatttctgtgaagttatattcggatattttttaagccatactatggaataattaaatctgtgtaacttataaccatggcagaaaaaacaaccttccggaacttagaaaaggtcacctgatatggaattgtaatttgattcttctttgaacccttacaaatgcagaagctgaacaaataggatttttcttcctacctgttcagctctttgtttacctgtaaatcaattcatttaacacaatctcttccgccatattacgaataccatttaccgctctgacccattccatctgatcacgaactttcaattcttccgtaatgccctgcctatccatcatctgacgcaccagaatatccattctctcctgtgcttcatcgtccacagtattcagatgttctgtcagtctgtcttccaacatatacaatgaatacattgccggacgatgctctttaagatatgtttttcgcatcattccatatttcccataatgcggttcttcatctgtactgacaagattcggatagtaaattccgtctgcgccaagtatgtaggttccacccattttttcaaatgtgcttttcatgtgttattcctccttgaaatcagcgatgtccttagatcatcgcaaaatatttcaaggcagccttgatagcttcttctttttctttcggacattgtggaactcttgcattttctgattttgaaagattatagttttctcccacttcaattccacatttgcgttttacctgagaaatatataaatttgaaaccttcaagccaaattctttcagcacataatctttgatttcctgataggttgctttcaactcggcactggtggcatccagctcgtccaggtctaagtcgatctctatcgtgtcaccggttttttttggacaaaagagcaaccgtctccacatgataagttcccgggaacaaatccaccccgctgatcttctccactttatatccacgtccctgtatcatctccagatcccgtgccagactggtcggtttgcatgcgatatacaccagacgctccactccgaaattcaggatcttcataagtgccttcggattcacaccgtctctcggcggatcgagcatgatcagatccggaacttcccccagttcatcaatgactttcaatacatccccggcccagaatgtacaattgtccagattatttaacttcgcattttcttttgctgcttctaccgcttcttctacaatctccacaccaaccactttcttcgcaaccggtgcgaggatctgtgcgatcgttcccgttccgctgtacagatcaaagacaactttttcattcgtatctccgatgtattctctggctgtctcatacaagacttccgctcccagcgaattagtctggaagaatgagaatggtgtgatcttgaattttaatccaagtaattcctcgtagaaataatcctgtccgaacaggacttctgttccttcgtcttttacgacatctgcaaggctgtcgttctttgtatgcaggattccgaccaatgttccatcaaagttcactgctgtcatcttttccagccatgcagccttgaatgtctggatttttttcattgcctctgccggatcaactccgagttctgccgtatcggatgctgtgaccagatccaccaggatctctcctgtctttactgcttttcttaccagtaggtggcggaaatatccgacatgacgcatgcggtgataatatggaagtcccgattctcccgcacattccagtgtacatgcaagaatctttctgtaatcttcatctacgatctgacaatctgtcacatttacaatatcatgaaaacttccgcgtttatgcatcccaagtgccagtggtccgtctttgtattcatctccgaatgaaaattccatcttgttgcggtactcggtcctgacaggacttggtttaatgccttcccagatatactccccgtctaccgcttcatccatcatttttttcacctgctcattcttcatggcaagctgctcttcatacggaagattctgataagtacagcctccgcactgtccgaaatgtggacaggctgacggaatctcgctggctgacggttccagtacttccagaagacgcccttctgcctttccttttctgatcttattgacagaaaaccttaccttctgtcccggcacgccattctttacgactacccatctgtcttcttccggcagataaatgcgccctttatttggaaattctacggattctataattccttcgtatacctgtccttttttcatatctatcctttctgtcatagcttttatctattgcaatttatttcattatctttactatttctggttctgtctcttgttccgcttttctatcctttatatactgctttcaggattgtcccttcctgttccactttcacatgtttcaaacttttcacatactgattgaactgggaatatccataatcgcggatcttaaagtctttgtatttttcatacattttatttcccagtgtactgagttctactccggatcttcccgactttttcacaatctgtacgacgtagctgtcgatattttccttcagatcctgatcctctcttaaagtaaccgacacaatatttccatgttttaccatctggattcttgtgaattcctccagaaacttggacagcatattatacccgtagctccgcacatcaaagtccgggtaaagactgaccagacggcttcctacttcaccgagtccggttggcttattgatatcctgattctcaatgatcatcttaatgatcgcatcttcaatcttctctttacttcgtctgtcatgtgttgtctcgctcttcgatgttcccggattctgctcactcatcagattttccagaatcgtaaacttatcacacgctttcctgaatggctccggagtcttattttctcccatgccaataaccatctttccgctctctctaagacggctgacgagtcttgtaaagtcgctgtcactggatacaatgcaaaatccatccacatcattcgtatacaggatatccatcgcatcaatgatcatagctgaatcggtagaattctttccttgtgtataactaaactgctggatcggcgtgatcgagtttgtcagaagttcatctttccagcttgaatgctgtgtgctcgtccagtctccgtatattcttttatatgtaatgatcccatattttgacaattctgtcaggatcggcttaatgtattttgctgatacattatctgcatcaatcagtagtgcataacactgttcctgcataccttctctctcttctttctataaatattactgaattttccatgcggacgcacttgagattgcaaaagaaaagcaggccagtcgcctttcttttaccagatcggtttctaacctgcctctttcttcacttattcatccgcccggttcttatacctgatcgtcatcatcgaaaaagtcatcgtcgaaatcatcgtcatcaaaatcatcctcgaagtcttccaggtaatccggggtaaagaagcaatatactgcataagcgattcctgcaactgcagctacagctccgactactgccagaatccagagtacggtcttgccgtgtttgtcctcttcttttttattcatcagttcgctaagcttggatgctgcaataatatcttctactttactcatgctcccacgtcctttcctctgctctttcggcaaatcattctttacttattataacactttacgtagtgtatgactacttatttttcagatttttctcctgtaacccggatagattccggattgttatactttctgaagtcttgcaaatgtggcaaacatcttcttcgttccgggtccgtcgaagtgaactgttacttcataatcacgtccgccttcaatgattgcagttaccgttccttctccgaatttgatatgtctgacacggtctcccactccgtaaggaagcttcccgtcttttggtgtcccgaactgctgtaccggctttgatgcggtaaatgccttcgtcttaaatgtttctttcgcctgcatgaaagaggtcttcacccttacctgctcactttcttctttcttctctttttttgctgatgatcctgtctccagaagttccaatgggatttcttttaagaaacgggacatcttcttatactgtgtctccccatgtaccatacgttttcttgcacaggtcagtgtcagatctttctctgctcttgtgattcctacataacataatcgtctttcttcttccagttctgccggatcgtctgctgtgatcgtcatatagctcggaaacagtccgtcttccattcctgccagatatacatgtgggaattccagaccttttgcactatgtaatgtcatcaatacgacataatccgtactttcatccagactgtcgatatctgctaccaaagctacatcctcaagaaatcctccaagtgtcggtgcttcattctgtagcgcacagctttcttcataagcagcgatcttattgcggagttcgtctatattttcaattcttgatgttgcctcttcactctcacattcgtggatcagcgcatcgatataaccagtttctttgataacttcctccaacagttccaatacactcatgtcttctgtatcattcttaaaatgctcgatcattgcaacgaacgattccagttttgcctgtcctcttccgatgttcgggatcaggtctacggcacgaagtgcatcatagaagctgcattctctggttgatgcatattcctgcacacggttgatgctggtcagtccaattccacgttttggaacatttacaatacgtctgacagccagatcatctcttccgttatcaatcgtcttcagatacgcaagaagatccttgatctcgcgtctcgcatagaagttcacaccgccgatgactttatatgggatgctgtcacggacaaaacgctcctcgaacatacgggactgcgcattggtgcggtaaaggactgcattatctttgtagctgcagagttctttattgacatgacgtctgatgtcaccgactacatattctgcctcttcataagcagaatcaaactgacgtaactgaatcatatctccatcttcattctctgtccagagtgtcttatcctttcttccctgattgttccggatcacggcattggctgcattcaggatattgccggtagaacggtaattctgctccagcttgatcactctggtatcttcaaacacatgttcaaaatctagaatgttcttaatgttcgcgccgcggaacttatatatggactggtcatcgtctccaaccacacacagattacggtacttggatgccagcagacggatcagttcgaactgtactgtatttgtatcctgatactcatctaccatgatataatgaaaacgctcctgataatattccagtacatctttctgtgtctggaaaagctgcacggtcttaaacaacagatcatcaaaatctaatgcattatttgatcggagctgtttttcatattcttcatatacttctgcaatttttttccggctgtaatctccttccgcacgcatacggtattcctgtggcgtcaccagttcatcctttgctttggaaatctctgacaacagtgctctttcccggaacatcttcgtatctatctgcagaagcttacagacctcacgcatcagtgtcttttgatcgtcactgtcgtagattgtaaagttggtatcatatccgagcagatcgatatggcgtcttaagatacgcacgcacatggaatggaaggtgcttacccatatactctctgatccgtatccaaccaatttgtcgacacgttccctcatctctccggctgctttattcgtaaatgtaattgcaaggatattccatggattcacctgctgctcttcaattaagtaagcaattctgtgtgtcagaacacgggtctttccggatcctgctcctgcaagaatcagaagtggtccttctgtatggaacactgcttctctttgttgttcatttaatgtatcgtatatactcaatcttatggtttcctttctttccggttttttattcttcttttttctttccggcctgttctgctttcgtcatggattcatgctctctttttatttcgctataaagagccgttgatgtccagttctgattctttgcagtaacgattgccttcagcggaacctgtactttttcttttttcatttggaataatagcttatccaatatccgattgtctgccagtagcatgacaagcatctcttcttcaaagtctgtgatttcttcattcttttcattgtctgtcccggaaatttcctctcttgatgcctcttccgccacttcttctttcagtccggtcagtactccgattgtctttgaatactcttctttttccacatatttcacacgaaaaccaagaaaacttcccagcatgccgatctttcttccctttttcgtgcctttcagattataacatagcatgattgatttcatatgcattctaccccttttcgaatgtctgtttccattatagttgctttgtccgggttctgcaagaaacaatttgggacggaggattttaaaaaatcctccgtcccaaataaaaaaatgtcctgtccctttttcattttcattcatcatccgattcatttacgcgctgatcgcatttcccgtatacagctgataatatctgcctttctcttcgatcagttcatcatgtgtaccacgctcaatgattcttccctgttccagtaccataatgcagtcagaattgcggactgtcgataatctgtgggcaataacaaatgttgtccttccacgcatcagcttatccattccatcctgtacgatccgttccgttctggtatcgatggaactggttgcttcatcaaggatcaataccggaggatcaacaatagcggctcttgcaattgccagaagctggcgctgtccctggcttaaatttgctccgtctccggtcagcatcgtatcatagcctttcggaagtcttcggataaagctgtcggcatttgcaagctttgctgctgccacgatctcttcatcggtcgcatccagtttgccaaagcggatattgtcgcgcaccgttccggtgaataaatgtgtatcctgcagaacaatcccaagtgaatgtctgagatccgctttcttaatcttgttaatgttgattccatcataacggatcttgccgtcctggatatcataaaaacgattgatcagattggtgatcgtcgtcttacctgctccggtcgatccgacgaatgcaatcttctgtcccggtttggcatataatttgatatcatgcaatacaatcttctcatcattataaccgaaatccacaccattgaatacaacttcacctttcacctccacataatccacactgccatcattctgatgtgtatgtttccatgcccagcgttcggttctttcttcacactctgtaagctttccgtcttcttctttcgcattgaccagtgttacataaccttcatccagttcttctttttcatccatcagcttaaaaatacggtcggccccggccattgccataacaattgcattcatctgcatactgatctggttgatcggcatactgaagctcttattaaatgtcaggaagcttgccaaacctccgagggtaaaacctccgacctttccaagtgccagcacacccccgatgatcgcacagatcacataactgatatttccgatttgtgcattgatcggtcctaaaaaattggcaaatgtattggctttgtctgcactgacatatagttcatcattcaactttttgaagttctgcatgttctcctcttcatggcagaatacctttaccaccttttgtccgttcatcatctcttcgatataaccgttcacagttcccaggtctttctgctgttttgcaaaatatgccccgctctgtccggcagatttctttgaacagaataccatgattccgaccatgatcatcgttacgaccgtaagtgggatacttaagatcaacatactgacaaatacactgatgatcgtaatcccactgttcagaagctgcggcatactctggctgatcatctgtcttaatgtatcaatatcattcgtatataccgacatgatatctccatgtgcatgcgtatcaaaatacttgaccggtagtttctccatatgagagaacagatcatttcttaagttgcgtagtgtcccctgcgtcacattgaccatcagacggttataaccaaatgttgccagtacacccagtgcataaaatgctgctactctggcgatcgcatgtgcaagcggtgtaaaattgggattatctgataataaaaatggtgtgatatattcgtcgatcaggttcttcatgaacatcgttccctgcacattgcaaagaacactgacaacaatcaatactactacactgatgcagtgaaacttataatcttttaatacatatttcataaggcggaggaataattcacccggattttttacctgtgctttcattcctctcggctgtcttcccggccccggcatcttattcaccctccttctcgtcaaaatctccgccaccactggtctgtgattcatagacttcacgatagatatcattctgttccaataattcttcatgtgtaccgaatccattgaccttaccgtcttccataacgatgatacggtcagcatcctgtacgcttgagattctctgtgcgatgatcagtttcgttgtatccggaatttcttcacgaaacgctcttcggatcttcgcatctgttgcagtatctaccgcactggtactgtcatccagaatcagtacttttggcttcttaagtagtgctcttgcaatacatagtctctgcttctgacctccggatacgttacttccgccctgctcgatgtaggtctcatatcctttcgggaaacggtcgatgaactcatccgcacatgcaagttcacacgcgtgtctgcattcttccaaagttgcttccttgtctccccagcggagattatcaaggattgttccggagaacagcacattattctgcaagactactgatacctgatcacgaagcacttccatatcataatctttgacatttctgccaccgaccagtacttcgcctttcgtcacatcgtacagacgactgatcaagttaaccagactcgtcttggcacttcctgttcctccgatgattccgatcgtctcaccggagcggatcttcagattaatatcttccagtaccggttcgtcactgtcctttttatacgcaaagtccacatgacggaattcaatacttccatcttctactttcatggtcggatgttccggattcttaagatcactcgtctcatttaacacttcggagatacgtctcgcacttgccatactcatagcgaccatgacaaataccatcgacaacatcatcagactcatcagaatattcatgcaatatgtaagaagactcatcagttctcctgtcgtcagggaatcacttgcgatcatctttgctccgaaccagctcactaacaggatacaggtgtataccgccgtctgcatcatcggtgcattgaataccagatttgtctctgcttttacgaaaatgttatagatattctcacttgctcttcgtaacttagatgtctcctgttcctctcttacatatgccttcacgacacggatcgcagatacattctcctgcacggattcattcagatcatcgtactttggaaatgcctgctggaaatactttgtcgcatggctcatgatcagaaacaataaaattccaagaataattaccgctacaagatagatacatgccagtctcgcattgatcgtaaatgccataaccatcgcacagatcatactggccggtgctctggtgaacatacgcaggatcatctgatatgcattctgtatattggttacatccgttgtcattcgggttacaagtcctgctgtgctgaatttatcaatatttgaaaatgaaaatgtctgaatattgttaaacatagcctctcgtaagttccttgcaaatcccgccgatgcttttgcaccgaatcttccgcccatcattcctgcgaataatccgatgaccgccgcaacaaccatgattccgccgactttgtagatgtggtggatatccccggtattgacccctttatcaataattgatgccatcagatatgggatgatcatctccatcaatacctcaaggatcataaagagcggagttgcaatggatgctgctttaaattctttaatctgttttgctaatgtcttaatcattccatttacgccctttctgtttcgtttcttgttttatagttacatttataactccgattttccggattacctgacttcatatttcttcacattctgattaatctggtctaataccttatagaaaatatgaagttcttcttctgatatgccttcggaaagctcttcttcgatatgctccacaatatcctcaaaagattcctgacttgcaattcctttttctgtcaggattactttttttaacctggcatcctgttttaccgattctcttcttacgaatcccttcttttccatcaattgaagcagattcgtaactgtagatctacctactgcaaatctttgttcaatatccttctgaaaaatatcctgctcccggttctcatacagataccgtatgatccagccatgcatcatcgtcacttcatccactccggactttctcacatgtgcagacagattccttgacaatttcagatccgcacagtgtatctccggtccgatctttcttccttttctttccacattaccatcctttccgttcaattgttcacattcaaattgtttgttatcaaattgtttgttagcgaacttattttatcatatccaattaaaatgtcaataacttctccgatattcagccgtattttccagacattttctgcaacgtgtataaaaaaaacgcttgccatctagttttcaaaactatataataattacattgaggtgataaaaaatgacaatagacacaaaagatatgctgaacagcattttatcaagcatctcgcggattgattacgtgagacccgatgatattccgaatatagatttatacatggatcaggttactacctttatggaaaaagaactggcatccagtaaacgtcatgaagatgataagatccttaccaagaccatgatcaacaactatgccaagaacaatcttctccctccacctgtgaagaagaagtactccaaagagcatctgctgataatgatctttatctattattttaaaaattttctttctattaaagatattgaaactatgttagaaccgattacggataagtattttgacacagatcaggattttgatatcacttctatctataaagaagtatgcgaactggaaaagtccagaattccggaatttgaaaaagaaattatccgctcttataattcttctaaaaaatgttttgatgaagcaccggaagatgacagggattctctgcagttgtttgcatttatctgtaacctgagttttgacatctatgttaaaaagcagattgtagaaaagcttttggataatttccccgatctgcttcactctgaaaataccggtgtcaaaaaggattcggtcaaaaaaaagaaataagaccgcacgtcttatttcttttttgcttctgcattcttgccaaatgcatctgcactgttttttcgcactttattctgctttttcgtctttgacttccccaagtccaattctctcgaataccatgtcatatccgtcattaccgtaattcagcgaacggttcacacgactgatcgttgctgttgaagcgcctgtcttttctgcaatctcaagataagtcttgtgttctcttaacatctttgcaacttcaaaacgctgtgataatgaaagcaattcattaatcgtacagatatcttcaaaaaatgtataacactcctctttatctttgaggcttaaaattccctgaaacagataatcaaccgcctctgttctgattttcttactcatagcattatctccttcgtagcagattcattacttttacattttaacacactaaaattgcgaagtctatagttttttcccatgttttatacatgcttttaatttttccagtgaaacattggcaaccaattcttccggaaaatctgtttctctcaatatttcttccgcatatggatactctgcaatatctgtatccacatgtgaatcactgccaagcacgatcatcactccctgtgctttacattcctttaccatctccagacagttctcttttgtattttctcgaaatccttccggacgcagtgatgaattatttacttccagtaatgttccggtttcttttgctttttttaccagacgcttcatatctacaggaaatctcccgtcgtccggatgtccaatgatgtccacatacggatgttccattactttctcatatgctgcggttacattgtctattgtccgttcatctttaaaacacggcatatgaatactggcgattgcaatatcaagtctttcaagaaccgaatccgggagatcggtctccccccgcgcattcatgatattcagttctgttcctaataacagctcaatcccgtatttttttcttggaacaattcttaaattttgaaaatagaacaaatgacaagttccgggcatctctggtgcatgttccgtaattgcaagtcccttcagccctttatccgctgctgcttgcgccatctcattcagcgtattatatgcatgtccacttgcgagcgtatgcgtatgtgtgtcaatttctactctcatttcctgcttctccttcctgttgtatttcatcagatcttctttatctgttatttttatttgttattttaaattgtaacttttcttcttttcagctttaacgctctaatatttcacaacatgaagtattataccgtataattttctttttttctacccattctataccggaaagcaggttttcctctttttttactaaataaccaccatttattcacccctctaatatatctgaattataaaggagtttttattatgaagaaacatgaaaaaaagactgtaaatgtaaacccattatccaaccaggaactcattgattcttacgattatctcgcaactgctgcctcttctcatgactgtaccggtctgattccttctgcacctcttaatcctgcggaactggattcgtatgaggaactttatccattccttcctccggtctcatccgcagatgatgctccggagcaggctccgccttccggtaaaaatccatctgatattaagggttaatgtccatctgaaaatactctgcaaaatacctgttttttcttgacatgccttccaatcacagctaatcttatagaagtataaaaaatatattatgtatattgagaggtaactgatcatgaaaaacatactaatgatagcaaccggtggtacgattgcatccaaagagggggatcttggattgacaccggctgtgacaggggaagaacttgcagccagcgtaccgggaatcaaagacatctgtcatctggaaatacttcaacttatgaacatcgacagcaccaatatgcgtccacgtcaatggctgatgatccgtgatgcgatcatggaaaattataacaactacgatgggtttgtcgttcttcacggaacagacaccatggcatatactgctgccgccctgtcttatctgatccaggacagtgtaaagccaattgtactgaccggttcccagaaaccaatggccaatccttataccgatgcaaagatcaatctgttccagagtattttgtatgctgccgacgatctttcctgcaatgtctgcattgtatttaacggaaaagttgttgccggaacccgcggacgtaagcagcgcaccagaagttttgatgcatttgacagtatgaacttccctgaacttgccattatccgtgacagccgtatcatccgttactatacggaagaacgtcccgctcctcaggatctgaaatcttacgcaagtcttaatgaccgtgtctttgtgctgaaactgactccggaagtcaaagctgagattttcgatctgttgagtggtcactatgatgctatcatcctggaaacctttggtatcggcggtatcccggaatatgatgattcctttgaaaaagcgatcttctcctgggtagattccggcaagacaatcgctgtcaccacacaggtgccggaagaaggctgtgatcttggcgtatatcaggttggaaaaaaattcagtaatcataaaggaatcctgcagtccgatgatatgacaacagaatccattgttgcaaaactgatgtggattcttggtcagacggataaacaggatgagattgcgcggttattttatcgcgagatcaatcacgacagagtctgagttgatttgggatttaattcagaaaggcacgacgacccggacctgcataaaaagtagaaagccgttcctgttcaggttccgtcggcgggaaatactaaagcgtcaaaattatgctaaaaacaggattccgaaatttgcaactcgccattcggctcaaacaggcaaatttcgaaaacccaacgcataattttgacgcttaactatttccaacaccttcttcacattcactggaacggctttctactttttattccgtgggtatcaaatgccttacgaatgagatggcaaatgcgtaacggttgtggcctccaccgggttacacttccgggcattttatttattaacattcgctgccagttacgacttgagggaaacaatagataaggattattgtgaatgtggaatgccgttagaaacagttagagagtcagaagcaccgttaaaggaacgaagcgaacatgtttgaggcgaacgccgagtttgagcgtagttcctttgcttttaggtgattctgactctcttagtgtttcttatggtatggaacctgaacaagaagccttatctattgtttccttcaaggactgagaggccgcttccccagttaataaattaaatcccaattacgcagattctatctcgtaagtgaatccggcatcggttattgtctggatcgtatcgttgattccctgtccaccagcagtaaggtaaccggaggcaaagatggagtcgaccacacttaataattctttttcatgtcctttaaaatacacttcacgacctgcggcgcatcggatatcagactgcgggaccagaagtcttgcaaggcagaggactttcattccatattcataagtaagcccggagatatcctgatcgccaagaggagtaccgggaatcggaagcaggaagttgattggaagagcttccggattgatttcttttagttccaaaagcatatcgaccacatcttctttactttctcccataccgatgataccaccgctgcagatttcaaatccgagccgttgaagcatatgtatattttccacacgctggtcaaaggtgtgcgtagtacagatatgactataataattacggctgctgttcagattgtggttgatgcggtcaagcccggcatctttcaacattctggcctgcttttcggttaagaatccaatggagcagcagagatgggttccggtttccttcatcttgcggatacgcccggcaagctgttcaatatcggcatcggtgaatcccataccacttaatccgatgcagtggcgggaaagatgatattcatttacaaaatcattatcattatataatttgtcgtcgcctacccatttgtaagtgtcgatgtctgcatcagaacggcaggattgtgcgcagtaagcacagtcctgagtacagttgccgctgcggacattggtcagaatatgaatgctgacacggtttcctttatattttttacggagaatcccggcacgttcgatgagcatatctaactgatcatcaggagtattaagaatttcaatggcttcttctcgtgttaaaatgggatcttcgtgtgtgtgaatttctgaaatcatggtgttaccttcctttatatgtagtataaatcacttgttaactgatatagtcaaaaggttaacatactgaaaggagaaagtcaacatcagtcaaatgattggttaacatttgtgcgtaaataaatattacattgacacattctcagagaagtagtgtataatattattatggtatgtacagatgtattctatgaggagaaatattatgccaacacagaaagaagagttacgactgaatacacaacaggatatgtcatcggaggatatgtatgttttaaaggaactgttcacggaatatgtatcattataccggctggaactgaattccggaaaatatgaaattctgcggctgattgcaaatacgaacgcaaaacaaatcgtcggagaggagtacagaatatttgctgattatgatgaatttacaagacggtatgcagagacctttattccggaaacggaacaggaggaatttttagactggcataagtgtgaaaatctgaaaaagagacttcaggagaaggaaagacttacttattattatcacagtgtttccaaagacggaaaagacagttattatgaggcttatgcagtgaaaggaaagacagacgggaaaaatttttacatatttctggggtatcggaacgtggacggtattctgtataaagaaaaagcaattcaggaacaattacagagggcactggatgaagcgaaactaagcaatgagattatagaggctattgccaaaagctatcagtatatttcaagaattgatatttcgaaaaactggtttgaagaaatttcaaaccgggctgttgagaatatgaattataaaaaatccggagaagtgacttctggcaacaggaatgcatgcaagaagcttgtggcagaagagtatcaggaagcatttcttaaatttgcagatataacgacactgcctgtacgaatgaagaatgaagagaccattgtgatggagtaccagatgaaagatggcaactggcataaacttcgttttatcgagaagaaaagggacaaagacggtaatctgacccatgtattgtgtgcgattcgcagtatcagtgatgttaagaaaaaagaacaggaactgttacagcaggttgcggaagccaggaaagatgcagcgcttaaatcacggtttttgtctaatatgagtcatgatatccggacaccgataaatggaatcatcggtatgaccgagcttgcggatcgttatccggacaatccggagatgcagaaaaaatgtagagagaagcttttggaatccgccaggcatcttgtttctatggtaaatgatattctggatatgaacaagttagagacggagcaatttgtcgaaaatgatataccgtttaatttggcggtagtgttaaaccgagtcaacacagatcaacagatgcaggcaggtaaaaaaaagattgattatgttgtggactgggaaaaatcggagctgaatcatatgtatctgacgggaaatccggtttatatagaaaaacttctgacagtaattactgataatgcagtgaaatttacaaagccaggcggcaatgtgagtgtgtggtgcaggaaaatatcggaagatgacgagagagcggtttatgaatttgggtgttcagataatggaattggtatgagtgaggagtttgcaggacacgcatttgagatgttttcgcaggaaaataagacaagccggacacagtatgaaggtaccgggctaggtcttgcgatagcgaagaagattacagaaagacttggcgggacaattgagataaagagtaaaaagagctgtggaacaactgtgactatgacgattccatttaagaccggggtacagaatctgatgcaatatacagaaaatgtgaatacagaaagtacagaagatattccgttggaaggcttgcatgcattgatcgcagaagataatgagttgaatctggagattgcaaagttaatgctggaagagacaggaatctgtgtagagtgtgcggcagacggtaaagaagcagttgcgaagtttgaggagtcggaaccgggatattacgatgtgatttttatggatattatgatgccgtatatgaatggatgggatgcgacaaggaagatccggacattgcaaagaccggatgcggataagataccaatcatagcaatgagtgcaaatgcgtttgcagaagatatcattaacagccatatttcagggatgaactggcatcttacaaagcctattgatgcagataaactgatgacggcactgaaggagtgtataagaaaaaataatatcagatgatggtataaggctgcaaaagattgttgaaaaaagtaaagaggaagattagaatatgctatagagaaatctgtagcatattttaagtatgtgggaaagaaggagaacttatgtataattttaattattacacaccgaccaaagttgtatttggaaagaatacagaagaccaatgtggagaactcgtaaaggaacagggctgtaaaaaagttctgattcattacggaagtggaagtgtcagacgttccgggcttttagataaagtgaaggcttctctggatgatgcagaggtagattatatagaacttggaggagcagtaccgaatccaagactttctctggtgtatgaaggaatcgagcttgcaaagaaagaaggtgtagatttcattcttgcagtaggcggaggaagtgcgattgattctgcaaaagcaatcggatatggagtagccaatgaaggggatgtatgggatttctatgacagaaagcgtcaggcagcaggctgtcttccgataggggttgtacttacaatcgcagcaaccggaagcgagatgagtaattcttctgttattacaaaagaagaaggatgggtcaagagaggatacagcagtgattatggaagaccgcgttttgcgatcatgaatccggaacttaccatgacactgccagattatcagactgcatgcggatgtacggatatcttgatgcatacgatggaacgttattttacaaatggcgggaatatggagattacagacagcattgcagaaggtctgatgcgtaccgtaattgaaaatgcaagaattctgatccgtgatccgaagaactacgatgcccgggcagaagtgatgtgggcaggaagtttgtcgcataatggtctgaccggctgcggcgctgtcgtcggaggagacttcgcatctcatgcgttggaacatgagataggaggaatctatgatgtggcacatggtgctggacttgctgcaatttggggatcctgggcaagatatgtatacaaagactgtcttccaagattcgaaaagtttgcgatgaatgttatgcaggtggatccggaaggaacagccgatgatgtggccttacgcggaatagaggcaatggaagatttctaccgtgagattaaaatgccaacatctatccatgaacttggcattgatccgggcgatgatgagttgaaactgatggcacataaatgcagtatcggatgcaagggaagcaaaggatcagcgaaggtgctgcatgaagaagatatgtatgagatatataaagcggcattataggagaattggaatttaatttattaactggggaagcggcctctcagtccttgaaggaaacaatagatgtgtagatgttagagttaattactctctaacaactacacttttatggtactaaatggcaaatgcgtaatcgtagtggcttccaccgggttacacttccgggcattttatttattaacatccgttgccagtcacgacttgaaggaaacaatagatgaggattattgtgaatgtggaatgccgttagaaacaattagagagtcagaagcaccgttaaaggaacgaagcgaacgtgtttgaggcgaacgccgagtttgagcgtagttcctttgcttttaggtggttctgactctcttagtgtttcttatggtatggaacctgaacaagaagccttatctattgtttccttcaaggactgagaggtcgcttccccgttaataaattaaatcccaagaattacagaatatcaatatattctccggccaaagctttattcatacttctgactgcacagaattttccgcacatactgcaggtatcactatgatcatcttccgggcttcggctgtcacggatggctttggctgtttcagggtctaatgcacaggcatactgtgcgtcccagtcaagtttctgacgtgcttcagccattttatcatcaatatcacgtgctccgggaacacctttggcgatgtcagcagcatgggcagcaatcttggaagcaatgatcccctgttttacgtcatctacattaggaagcgccagatgttctgcaggtgttacataacataagaatgcagcaccattcatagcagcaactgcaccaccgatagcggatgtgatgtgatcgtaacctggagcaatatccgtaacaagagggccaagtacatagaacggagcacccatgcagatactctgctgtactttcatgttggcagcaacctgatcaagcggtacatgtcccggtccttctaccattacctgtacattgtggtcccatgcacgttttgtaagttctccaagacgcaccagttcttcaatctggcatacatcggtagcatcggccagacatccagggcggcatgcatcaccaagggagatagtaacatcatattcttcgcagatatcaagaatctcatcatagtgttcgtagaaaggattttcttctccggtcatacacatccatgcaaatacaagacttccgccacggcttacaatattcattttacgtttgtgtttttttatctgttcaatcgttttacgtgtaattccgcagtgaagtgtgacaaagtccacaccatcttctgcgtgaagacggacaacgtcgatgaagtcctgcgcagtcagagttgcaagatctctttgatagtggatgacactgtcgtatacaggaacagtaccgatcatagcaggacattcatgtgtcagtttctggcggaatggctgtgtgttaccgtggctcgataaatccatgatggcttcagcaccaagatttacagcgctcataactttttccatttcaatattgtaatccttacagtcgcgggatacaccaaggtttacattgatcttggtacggagcatgcttccgacaccctccggatcaaggctggtgtgattcttgttggcacagattgcaaccttgccttcagcaacaagtttcataagtgcttctgttgtcatgttttctttttttgctacaatctcaatttcaggagtgacaattccctttcttgcagcatccatctgtgttgtgtaatttctcatgtgtttgcctccgttaaaaaattaaatataaggttataatgcgtcagcaaaacacacagatttcgatgcaggaaaacatttctctacacagatctgaggttcataaaagaactatgaaattactgacgcctatatcagatgggaaatctgatacttgtgtatgcggtacaaggtggtgtccccaatgtaccgtttctaaacaactcttaacgagtcgtttttatcatagccattacgccgcctttattcagcgctgtaatcagcagaaatgcaagaatgcttcctacaatagtagaaatcagaaatggaactacatagacgaagattccggcaggagtgattcccataatatatactgcaacaggataagcagccaggccgccaagaattcctgtgccgagtgcctctgcaagacaagtcaggctgagcttgtggcaaatggagtatacaagtccacagcaaagtgctccaaccatacttccgggaaaagccatcatgctgccaagaccaagcagatttcgtaacaggctggcacagaatgcaattcctacactgtaccagggccctaacgtgactgctgccaggatattaataatatgctgtacaggtgcacatttactgcctgcaaccggaaagcttaagaaacttccgacgatggcaagagccgtaaatacaccggcaagagccagtcgtcttgtccgtgaagagtctgatgataaagttgtgtgtgtcataaataaacattcctttcataaaaaaatacccttcattcataaagcggatggagggtacaaaaagtaaaaaaagaagagatgcggggggcatctctgtcaaatcaatacatggtatgaatccctccgttggcattatccaaatcaggtaaagggtcgaaacggaattacgcttcctctcagccggttttctccagctccccctgttaatatgaactttgttcacagattattatagcgtagtcaatatcagatagcaagagagaatgagaaattttatatacatgtgatagaaaattatggtaatatatagaaagatgttgtaaatgaatatgttgctttaaagcgcagatgtgtgaactggaggttcagaagaatgagagagaataatttggcaaggtttataaaagcacaggattctgattataagacggctcttgcagaaatcaagagcggacataagagaaactgctggatgtggtatattttcccacagatacagggacttggcagtagtggtactgcaatgtactacgctattgagaactatgaagaagcaaaggaatatatagaaaatccggtaacaggtgcgcatttaagagaaatctcagaaacactgctttcactggaatcgaacgatgctacgcaggtgatgggatggccggatgatttgaaactccgttcttccatgacattatttgcactggcaacgaaggagaatgaggtgttcttaaaagttctggataaattttatgataatcagccggatgcacagacggtagatattttggatatgggatatctggtaatgaaaattgatgaaccggattttggatgtgaaggaagaccggacggggtagaaccaatggctaaagtaacccttctgaagctgaaaagtgaagaagagattcagttagagattccggatgcggaactttaccggaaagagattgttgaggggagcgaagttgcagtcagtccggatggagtcatgattaagatgtaaacagatcagggagccggttcagaagacgataagtaaataagacgggtaataataagtaataaaggggagtttcaggtgaaagacagagacgagaaaaaagagaccaagaagaaaagaaaagaagagaaggaagaactgaccggtatggcggctgtatgggattatctgaaaacatttctgatcatattctgtgttgtatttgcaatgaacaaactggtgtatatcaatgccgtgattccgtcggaatccatgcaggatacgatcatgaagggggaccgtgtactgggaaaccgtctggcatatataaaggatgacccggagagatatgatattgtaatcttcaaatatccagatgatccgtccaagatttttatcaagcgcgtgatcggactgccaggagagacggttaccgtgaaagacgggaagatttacattgatggaaaagagcagacacaggcggtaagcttctgcccggaagagatggcaggaagcttcggaccttatgaagttccggaagatagttattttgtaatgggggataaccggaacaatagtctggattccagatactgggataacacgtatgtaaagaaagaggcaattctggccaaagcaggattccggtactggccgcttaataaagttggatttgtaaataaatctgcagaaaaatagttgcaattgttttccgtgttttatataatgaataaagttttgcgagaaaaggctctgaagcgatatcagggtcttttcttaacgtaaacacatagaaggcagcttgaagatgaaagatagcgatatacacagatgacggaaaaggaggaaaacaggatggaaaaagatatgacggtcggcactcccgggaagatcattttcaattttacaatgccgatctttatcggtaatatttttcagcagttttataatatggcagatacggtgatcgtcgggaaatttgtcggtaatgcggcactggcggcggtaggagcatgtggaacactggtatttctgatcattggcttcctgcagggagttacggcgggatttacggttgttacagcacagcacttcggagccggaaacatgaaggcgatgaagaagtctgtggcatccggtgcggtacttacagggatcgtaaccgttattcttacattgctgagcatgatcagtatggcgaaggtgctgcatctgatgaatacaccgtcagacatgtatggagaagcttacggatatattatggtcatttgcggcgggattgtggcacaggcactttacaattatcttgcaagtgtattaagggcactgggcgatagtaagcgtccgctttattttcttgtgattgcagcacttttgaatattgtgctggatctggtgtttatcattgtatttagaatgggagcggcaggggcagcctatgcgacagtgatcgcacagggaatttcgggaatcctgtgtctgatatatattgcaaagaaggttcccgcactgtatcttcatagagaagactgggaaatagataagaatctggccggatggcagctgaagatcggacttccgatggcattccagtattccatcacggcgataggaacgattgttgtacagtcttgcctgaatatcctcggttctacagctgcagccggatttgcggcagcaagcaagatcgaacaggtgtttacgcaggcctacgttgcgcttggtacaacgatggcgacttactgtgcacagaatatgggggcagggaaatatacgagaatccgtaaaggatttaagagtgcaacattgattggatttatttatgcggttgtgacaggtgtgattattttctttgccggaaaatatatgacgatattctttgtatcagagaatgtaaatcagatcatggaatatgtggatatttatttgaggtgtgtaagcgtgtcattcctgcctcttgttattgttaatttgtatagaaacggaattcagggaatgggatatggactgcttccgatgacagcggggattgcagaacttgtcggacggagcggtgcagcgctgattgcatcacattttggcagctatatgggaatctgtctggcatctccggcggcatgggtgctggcgggaacacttcttcttattatgtactttgagatcatgaaaggaaagaaagacagaaatttgaaaaatagatagaaaactgaaaagcaacttgttataataaaatgtacgaataaacatagaaacattgatgggtgaaacagcatgaatcaaagagtaataaaaaaagtccgctgtaatatctgttcagcgggatgtccgatcgatgcttatgtagaagaaggaacgcttgtgtcggtagaaggcagccgggatcttccggggcagagtggaggattatgttctaaaggagctgcttccaggcagtatgtttataacaaagacaggattctgtatccgatgaaacggatcggaaaaaaaggaagcggggaatttgaacgcatatcctgggatgaagcgtatcggatgattgcagagaatcttctcaggatcaaaaaagaatatggtccgcaggcggcagcattttatgcgggatatccgaaatggtacagaccggcacttctgcggcttgccaatgcttacgggtctccgaattactgtacggaatccagtacctgttttcagtcggcggcaatggcatggagatctatttatggaaatgacatctgctttccggatctgatgcatgcacagacggttctcgtatggagtaacaatctgtatcattctaatgtgggaatggcaagaccttatcagtcgttaaaagcacgtggggcgaagatcatagccgtagatccaagagagaccgtaacgacacaggcagcggatattcacttgaaacttctgccgggaacggacggagcacttgcgctgtctatggcacaggtgattatagaagaagggctgtatgataaagaatttgtagaaaaatatgtatatggttttgaagagtacaaagcgtatgtgaatcaatttccaccggaaaaagcagagaagatcaccggtgtagataagaaactgatccgtgaagctgccagaatgtatgcatctaacggtccggctggcataatgttttcagcgtctccagttgtacataatattaatggaatgcagaattaccgtgcagtgatgtgtctgatcgcacttactggcaactatgatatcccgggtggcaatccgtcaagaccgggtccggtgtctccttgcaatgaatatggaaaagtaaaacggctggatacgatagaagccatcggtgagaaagattttccggcatggtttgatctcccgtgtgaggaagcgcagtgtacaagaattgcagattatattctgaaggaagaaccatatccgctgaaagctgtggtgggattcggcctgaaccacagaatgtggccggagccggagcattttcagaaagcattaaaagcgctggacttttatgtgaatgtagatctgtttttctcggattcaagcaagatggcagacctggttcttccggcagcgtcttcctttgaacgagatgttgtgctgaatggacggggaggaatgttcttcctgtcagaaaaagcaatcgaaccgatcggagaggcgaagaatgatattgagatcatgatcggcatgcttcgtgccatgcagttacatgatgaagcattggaacatggctatgagaaatatatggaatatattctggagccatccggtgtcacactggaggaattgcgggcgcatccggaaggggtaaaaggacgtgtgatcattccgccggcatttaagagatatgaaaaagaaggctttcatacaccatccggtaaggtggaatttgtatcacagatactcgaacgttacaaagacagccacggatattccggacttccggaatacagagatttccgtgaggtgtcaggcatggacagggaagcatatccactgattctgaataccggttccagaaaaccacagcttttccatgcaagaacataccgggtaccgtggcttgcaggacttgaaaaggcaacactggtagagatccatccggaagatgcgaaaaagtatgatattgcagatggtgacatggtgagggtatcttccccggtgggaagtatctgcggaattgcggcggtttacctgaacagccagccgggaattgtacacgtctatcatggcaatgcaaagggtgaggcaaatgatctgatagacagaaattatctggatccaatttcaggattcccgggatataaaagttatttctgtaaaatcgagaaagaaaaaggcgaggtgaaggcatgagttaccgattaaaatttgatccggataaatgtgtcggctgttatgcctgtcatatagcctgtctggatgcacaccatgatgtggaagatgtagatgcaaagagccatcggacggtcaaaaaggtagtgaaaaatcagtttgaaaagaatatctgtccgggctgtgatcactgcggtatctgtatcaaagcctgtccggtgcaggcaatttacaaagatccgaagactggatttgtactgacagacaaagaaaaatgtattggatgtcatgcttgcgaaaaggtctgcccgaaagacgtgatccattttgacaaggacggaaaaatggaaaagtgtgacgggtgtattgaaagaatcagggaagggcgggaacctgcctgcgtcagagtctgttttcccggtgcgatcacactggaataaagacgaatagataaaaaggtgagactgataaaagtaagaatagatgaaactggataaagctaagtaaagagagataaggataaaggcgtatgttaaaaatcaaggaatatgtgaaggcagaaagtctggaacaggcatatgaactgaaccagaagaggacgaactgcattctgggcggcatgttgtggcttaagatgtcgaaccggaatgtacagaaagcgattgatctgtccggacttggtctgaatcagatcgaagagacagaagaagaattccggatcggatgtatgacgacactccgtgaactggaatgtcatgaaagattgaaccagtggtgtgaaggcgcagtaaaagatgcggtcagtgatattgtcggcgtacagttccggaaccttgcaacgattggtggaagtatattcggacgctatggattttcggatgtactgacggtgtttcttgcaatggacagttacgtagaactgtataaaggagggattgttccattacaggaatttgcgcagatgaaaagagacaatgacattttagtcagagtcattgtaaaaaaggatcagagaaatatgatttatctggcacatagaaattccaagacagattttccggtattgacatgtgcggtttcagtaaatgctgaaaatggatgcgtatgtatcggtgcaagaccgcagaaggcggtccgactggaactgacagaagcagtcagagaaaaagtatggagcggtgtctgtactgaagaagagatgaagaaagaggcagaatgcattgcttcacaggtgaagacggacagtaatatgcgcgccggcaaagaatacagaagccggctggcatatgttctgatccgcaggacattggaagcactgaatacaaaaggaggagatcagtaggatatgaaagtaaagattcttttaaatgggacaatgagagaagcggaaatatccagcgatcagcttctgatcgattttgtcagagatcatggatgctatagtgtaaaacgtggatgtgagacgtcgaactgcggcctgtgtacagtgtttgtagatgataaaccggtattatcctgttcgatgctgacagccagagtcgacggatgcaaggtagatacgttagaaggacttcaggaagaagcaaaagaatttggtgcatttgttgcagatcagggtgcagaacagtgcggtttctgcaatccgggaatgatcatgaatgcaattgccatgttccgcgagaatccggagccgacaagagaagagatcaaggcatatcttgcgggaaatctttgtagatgttccggatatgaaggacagcttcgtgcaatggaagcatttatcgaatacagaaagaaaggagaaagatcatgaaagcagtcggacaaccgataagaaaaaaagacgcaatggcactggtgacaggaaagccggtatttatggatgatcttgctccaaaggactgcctgatcgtaaaggtactccgaagcccgcatgccaatgcaatcgtaaaatcagtaaagacagatgtggcaaaaagagtgccggggattgaagacgtttacacatgggaagatgtgccgcaggaaagatttacaacagcaggacagacctacccggagttcagcccatatgaccggctgatcttggaccggaatgtcagatatgtgggagatccggtggcaatcgttgcaggtgagaatgaggcatgtgtggataaagcgttaaagatgctgaaggtggaatacgaagtgcttccggcagttctggattttcatatggcaaaagatggtgatgttctggtacatccggaagataactggaaagcactctgcaaggtaggcgccgataataagagaaatctctgtgcaagcgattctacggaagatggagatgtggatgcagtgctggcagattgtgatgaggtcgtagaaggaacttatcacgtcagggctgcgcagcaggccatgatggagacattccgtactacttgttttatggatgcttatggaagactgaatattttaagttccacgcagatcgtatatcatgtaagacgaatcatttccaatgcacttggaattccgaaatccaggatccgtgtcagtaagccaaggatcggaggaggatttggtgcaaaacagtcggttgtggctgaattattcccagcatttgttacatggaagaccgggaaagcatcgaagatgatctttacgagagaagaatcacagattgcatcgtctccaagacatgagatggaagttcatgtacgtcttggtgcatccagagaaggaaaaatccgtgcgattgatgtgtatacactgtcaaatacaggggcatatggagatcacggtccgacaacagtcggattatcgggacacaaatccattcctttatatagttctgcagaagcacaccgttttgcatatgatgttgtctatacaaatcacatggcagcaggagcgtaccgcggatatggagcaacacagggaatctttgcggtggaatctgcggtaaatgagatggcgcagagacttcatatggatcctgtggagattcgtcttaagaatatggtaagagaaggcgacgttatgccggcatattacggtgagacggcgaagagctgtgcacttgaccgttgccttgaacggactgcggagctgatcggatggaaagataaatacccatacaaagatatgggaaacggcaaagtcagaagtgtgggaatcgcaatggctatgcagggttccggaatctccggtgtcgatgtaggatctgcaactattaagatgaatgatgatggattctatactctgatgatcgcagcagcagatatgggtaccggatgtgatacgatccttgcacagatggcggcagaatgcctggattgtccggtggaaaatatagaagtcctcggagcagatacggattcgtctccatacgattcgggatcttatgcgtcaagtacgacatatgtaaccggaaaagcggtagaaaaagcctgccagaaactgatcgccagaattcttgagattgcatccggtatgctggatgcaccggtggaagaactggaatttgcaagcgaccgtgtagaatggccaaaagcacggaagtctgtatcactgatagatattggtacgaaatcaatgtgtggaaatggctgtgcactggaagcgacagaaagtaacagttcaccgacatcaccgccgccattcatggcaggagctgtggagattgaactggacaaagagaccggtcatgtggagatattggattataaagcggttgtggactgcggaacagtagtgaatccaaatcttgcaagagtacagaccgaaggtggtctggtacagggaattggcatgacgctttatgagaacatccagtacaatgacaaaggaaccatgttgaataattctttcatgcagtacaagatcccgtccagaagagatatgggaaacatccaggtggaatttgaaagcagttttgagccgacgggaccgttcggagcaaaatccatcggagaaatcgtaattaatactcctgcaccggcacttgcacatgcaattgccaatgcgacaggaatttggtttaaggaacttccgattaccagtgagcagatcgcaatgggagtttttgagaaggaagatataaaatagatcatatattaaaaaatatatgtataaatgacttgcaatcagaacgaaaagtcattacaatatggggtaacgtttagaaaaatatgtggaggccgctaagatgcagttattaaaagacagaatccgcaaggatggaaagataaaagaaggcaacgtcttaaaggtggacagctttctcaatcatcagatggatgtaaagttatttcaggaaatcgggaaggaattcaagagaagatttgaaggtgaggagattacgaagattcttacgatcgaagcttctgggatcggaatcgcatgtgttgcggctgaagtatttgatgtaccggttgtatttgcaaagaagacacagacaaagaatattgcaggggatgtatatacaacaaaggtagaatcattcacacacggaagagtttatgatattatcgtttccagagaatttcttggaaaaggagataaggttcttctgattgatgatttccttgctaacgggaaagcactggagggactggcagaactggttaaaaagtcaggagccgagctggtcggagctggtgttgtgatcgagaaaggatttcaggttggtggagatatcatccgctccaaaggaattcatctggagtcgctggcaatcgtagaaagtatggatgagaagacaggggaagtcgttttccgtaattaacagctaaaattcaaaggattttttaagggaatgtgagggtttcatattcccttttttttattcctatgctatactttatgataagtatgtgaatgcataaagagaacttatagtaaggagtaagaacttatgaaaagagtattgttaaaactcagcggggaagctctcgcaggcgataaaaagacaggatttgatgaagctacctgtatgggtgttgcaaaacaggtaaagcagcttgtagatgatggggtacaggttgcgattgtaacaggtggtggtaacttctggagaggaagaaccagcgagacgatagaccgtgttaaagcagaccagatcgggatgctggcaacagttatgaactgtatttatgtatctgatattttccgttatgcaggaatgaagacagaagtatttacaccatttgtgtgtggcgcatttactacattgttttctaaagatgcggcagtagaagcactgaatgaaggaaaagttgtgttcttcgcaggcggaacaggacatccatacttctcgacagatactggtgcggttttaagagcaattgagattgaagcagatgctatgcttcttgcaaaagcaattgacggaatttacgacagcgatccgaaggttaatccggaagcaaagaaatatgacgagatttctattcaggaaattattgataagaagctgatggctgtagacctgacagcatctattatgtgtctggagaataagatgccgatgctggtattcggactgaatgaagagaacagcattgttgagacgatgaagggaacatttacaggaacaaaagtaacagtataagtattattatggattattgcgataaaaggagatcacgctatgaatgaaagattaaaaacatttgaggaaaagatgaaaaaaacaattggaaatctggacggagaactttcagcaatccgtgcaggacgtgcgaatccaaatgtgttaaataaaattgtagtagactattatggaacaccgacaccaatccagcaggtggctaacgtatctgtaccggaagcgcgtatgattcagatccagccatgggagaaaagcatggtaagagagatcgagaaagcaattatgacttctgatctcggaatcaatcctaccaatgacggaacaactgtacgtcttctcttcccggaacttacagaggatcgtagaaaagaactggttaaagatgttaagaaaaaaggggaagctgcaaaagttgcaatccgtaacatccgtcgtgacggaattgatgcagctaagaaattaaaaggaacagatgtctcagaagatgagatcaaggacatggaagatgatctgcagaaactgacagataaatatgtaaaagaagtggataaagctgtagaatcaaaatcaaaagaggttatgacagtataagatctgcaacagataaaaaggtatagaataagaaggggataagatccagagaatctggaactgtcccctctgttcttgtatgactgaagagcactaaaaagttttttgattacataagttcgaatgtgttagtaggaggaaataatcatatgaatgtaccaaagcatgttgcaatcatattggatggaaatggccgttgggctaaggcaaagggaatgccccggaattatggtcacgcacagggcagtaagaatgtagagcgtatctgtgaggaagcatggagaatggggattaagtacttgactgtctatgcattttctacagaaaactggaaccgtccggatgatgaagtcaatgcattgatgaagcttttacgtaattatatgaagacatgtctgaagacagcagcaaagaatgatatgaaggtccgtgtgattggagatatcaccagactggatgaagatattcagaagagaattctggaactggaagaggcaacgaagaataatagcggtctgaatttccagattgcgatcaattatggaagccgtgatgagatggtccgtgcaatccggaagcttgcaaaggattgtatagatggaaaagtgaatccggaagagattgaagaacagacatttgaacaatatctggatacaaagggaattccggatccggatctgatgatccgcacaagcggggaactcagactttccaattatctgttatggcagctggcgtatacagagttttattttacagatgttccatggccggatttcagtaaagaagaactggaaaaggcgattgaacagtataatcaccgcgacagacgttacggcggtgtgaaggaggaagaagaacagaatgtttaagacaagattattaagtgggattgttttggtcattatcttaatagcaacagttggaaccggtggcagattgttgttcggttttctggcactgatcagtctgatcggattgtcggaactttataaagttgtggatgtgcagagcaagatattaggttttaccggttatctggcagccgttgtatattacggaatcttatataccggacagatgcagtatgtgacatttcttacgattgtatttctggtcgtactgatggcggtatatgtattttcatttccggtatttaaagcagagcaggtgatgacggtattctttggtgtattttatgttgcagtgatgctgtcttatgtataccagacaagaatgctggatgacggagctgttgcagtatggcttatctttttgagctcctggggatgcgatacttgcgcgtactgcgtaggtatgcttcttggaaagcataagatggcaccgaagttaagcccgaagaaatctgtagaaggtggaatcggtggaatcgtaggagcagctcttctaggggcaatctttgctcttgcagcgaataagattacaggagcaagtgtgaatccgggacagtatgcaattatctgtggagttggaggaatgatctcacagattggtgatcttgcagcttctgcgatcaaacgtaatcatgatatcaaagattatggaaaactgattccgggacatggcggaattcttgacagatttgacagtgttatctttacggcgccgatcatttattatcttgcaacatttcttgcaggcagattgtaggaggttcatatgaaaaagatagcaattttaggttccactggttctatcgggacacagacgctggaagtggtcagagagaacggtgatattgaagtgcttggactggcagccggaagtaatattaagatgctggaagaacagatccgtgaattccatccgcagatcgtggctgtatggtcagaagaaaaagcagaggaattacgtgtgaatgtagcagatacggacacgcagatcgtggcaggcatggatggacttctggaagtcgcaaccatgaatgatacagagattcttgtgacagcggttgtcggtatgatcggtatccgtcctacaattgaagcaatcaaggcaggaaaagatattgcgcttgccaataaagagacgttggtaacggcaggacatatcattatgccgctggcaaaaaagatgggagtatcgattctcccggtagacagtgagcatagcgccattttccagtcattacagggcaatcgtcacggggcagttcataagattcttctgaccgcatccggcggtccgttccgtgggaaaaaatcagaagaactgatggaaatcaaggtggaagatgcattgaagcatccaaactggtcaatgggacgtaagatcacaattgattcctctacaatggtcaacaaaggtctcgaagtcatcgaagccaaatggttatttgatgtagatgtggatcgggtgcaggttgtagtacagccacagagtattattcattctatggtagagtatgtagatggtgcgatcattgcagagcttggaacaccggatatgaagcttccaatccagtatgcattatattatccggagagaagattcctcccgggggacagagtagacttctggacattgggaaaactggaatttgagaagccggatacagatacattctatggactggagcttgcatacgaagcaggaagaaagggcggaagccttccgactgtattcaatgcagcaaatgaacttgcggtaagcaagttcctgaacagagaaatcaagtatctggagatcacggagatcatcgaagactgtatgaaggcacacaaaaatattgaaaatccaacattggaacagattctggagacagaagcagcgacctatgaaagaatcaacagcaggaggtaattagaaatttgggaattatattagcaatcttgttattcagcttcatcgtattttttcatgagctggggcatttcttactggcgaagaaaaatggaattgatgtagatgagtttgctataggaatgggaccggcaatttattcaaaagaatataaagggaccagatacgccgtacgtatccttccaatcggagggttctgtgcgatgggggaagatgaagaggcgaatgattcgccgaataactttaataataaatccgtatgggcgcgaatctcagtcatagcggcagggcctgtgtttaactttattctggcttttatctttgcagtgatcataacggcaatggttggttacgataagccggtaatcggggcagtggaatccggatatccggcagcggaagctggtttgaaaaaaggtgacgagatcgtgcagatgggggataaaaagatccacattttccgtgaagtcagtttttataatcagtttcactctgatgaagacgtggttgtcactgtgctgagaaacggaaaagaaaagaccgttacactgactccgaagatggacaaagaactgggatataagagactcggaatcggcagttccggttataccaaagccaatgcactgacggcggtcaaatatggcggctatgaagtgaaattctggatctgcacgacactggacagtctgaagatgttagtgaccagacagatcggagtgaacgaactttccggaccggtcggaattgttaatacggtagataccacctataagcagagccgttcctatggtctgtttgtcgtcattgtagagatgctgaatctggcaattctgctgtcggcgaaccttggtgtgatgaaccttctgccgcttccggcactggatgggggacgactggtgttcctgatcatcgaagcaatcagaggaaagcgtgtgccgccggagaaagaagggtatgtacatttcgcagggatcgtgctgttgatggcgcttatggtgtttgtgatgtttaatgatgtgcatcggatattctttgggggatagaagaaatcattattgatgatcttaagatttgcgttgcagatttggtgaaataattactattatttttataattttgtttttaaatcggaaagaaatcaaaaaggagatctttccgattttctgtgcgcttggctgcgcatgttgcagtaaaatatatagttgggaaaatgacagatgaagacttattgcatcaattaaaagctgcaagtgaaaatcactgccttttttatgaacaggtatctggtgaatggattgacggagcagaaaggaagaaaaatgagaaaagcgattgtatacacatctgtgcatcatggaaatacggaaaaattagtaaaaaggatagcagaagaatgtcaggtggatttgatagatgctataaaacaaatgaacgcagatttaaatgattatgatatgattgggttcgcatcaggaatctattattcaaaattccaccagtcaatattaaaattttctgaggagaatttatcagccgacaaaaaggtatttctgatctgtacttatggtggaagtgcaaattttaaatctatagaacagattttgaataaaaaacatgccagtgtggttggaaaatttggctgtaaagggtatgacacattcggtccatttaaactggttggtggtattgctaaagggcatccagatgaagaggatatgaaaaatgcagtggacttcgtaaaaggattacattaattgaaaaattcagattatataatcaaaaggcatgcgaaaaatgaatggacatttttttcatgcctttttaaagcattaggtgacgtagaactcaaagttagcattttcccatgtgggggaaatggttgtcagttcaattccgcaatccgcgatacccccacatatatctccgatatcttataccaggtcgtataatccacttctccggtctgaggcagtccaaagactttttgaaatacccggacagcttcggcagttgccggtccatagataccgtcagcagtgatctttggaatagccggataagcacctgcaatcacatttaactgctcctgcatctgccggactttgttgccggatgagccaatcttcagagtataaccaggccaggaggacggaatgccggagatggcttcggcggtgttgatgtacatgtcatcaccataataatagcgtaggatttcgataggagagtagccctgatcgcctaatgatttggatccccattgtgtcatccagttcggacactgcacctgccgcccgtcacaatactgtgtcagtatcggctgcttcacattcggtctggaaagataatcggcaaacaattcatcaacgatcacagagatcgtatcatagatattccgttcgggaatccatttatggtcaaaagcggtggatgaggtaatcgtgaaatcatatcctttgttccggtaccattctgtatacacacggttcagtgtgaaggacatgatcgccagaacatttgcccggatcgtatcttcaggccaggtagcatagatttcgctggaagccacatttttgatatagtctttatactttacgtaataatttcttgcggtagaatcccgcgggcttccatcgtggacaacaatatattcaggaacgacgacacgacttaagacaatctcaccggattcgatggttggcttgatctcatcctctggaatcttgggtgggtatgtggcatataatgtatgagcgggtatgacgaacatagcttcattttcttcctggttatcgacgggtttcatgctgacattctgcagggctgttacgtggggcagaatctctgttccggcaatgctgacggattcatatccggcagcagatatttgtaaggtgtattctgaatatggctggatctcattttccgggtccaggctgtattccagcggtggtgcggcaagatcgatcatatcggtctgtccggaactgtcggtagtaagctgctctaaaggagtttccgggataccggtgtaggagatggaaatccgggctccctgaatcggatatgcagtgatgtcggagacaagattgatctgcagacggcctttatcaggagtatcctgagtggttggagtcgctccattcataataataggacctcttttaagactctgttactgacagagtatgcaaaagtaagaaaaatgtgagaattgcggaaagagaaagaaaccggtataataaagtattcctacattatgcaggaaatcataagaatgatagaaacaggagcgaaaaacagagcatgaaaagaagacatttgcgaatatatagaaaaagaagaaaaaagaaaacgctcatcctgattctgatatgcatcttactcataggaatcgcggcagcagagcgaatcggatacatagatatggaacagtttatttccaataaacaggaagcgattccttatcagaaagtatccaaaacggcagaagagaacacagaaaaatactattaccggcaattgccggaagaacagaagcaagtttatcgggaaatcctggaaggtgtcagaaatcacacagaggagatatatgtacatgatacagatgcggatgagacgaatcagatattccggaagctgatgaaagatcaaccggatatcttctggtgtgatggaacagcgacagctacaacgcataagggaacggaaagctatacggttctgaaaccaaaatatttttatacagctaaggaaagccagacgatgcagacagagattacgcaggcggcagcaaagtggctggcaggtctggatgctgacgcagatgagtatcaaaaaattctctatgtgtatgaaaaaatcgtagatgaagtggactatgacgagagtgcaccggataaccagaacatttacagcatatttgtcaacaggcaatccgtatgtgccggatattcaaaggcaacgcaatacttactggaacagcttggtgtgttctgtacttatgtgacaggaaagacgacagaaggcggaaaccatgcatggaatctggtgaagtgcaacggcgattattattacgttgacacaacctggggagatccggtgtttcagcaggaagaaggcgaggatatatcccgggatacaaatcaagaaacagacacttccgggaataagacaaatatcagttatgattacatgtgctgtgatgatacacagctgttccagacacatatcctggataaagacacgcagatgccggagtgcagcaagatggattgcaattattatgtggtaaatggaatgtattacacgcagtatgatgcggaacaggcattgggagccatgaaccagacgatctggacgaagaaaagtgcgaccactttcaagttctctgacaatgcgatttatcaacaggcgcatgatgacattttccagaaagaacttgcaaaagcagcgcagaatctggcagactactatgggttatcacaggtgaagtaccagtacatcgatgatccgagattacacaagattgtaatattttggcagtattcataaaaaaacaaaaatatccgttgaaaatcctcggattatgtagtataatttttacaatttgtgaagacataaattgtctggtaccgatggatcaaaacagggcagttttgtgcttgcacaaactgccttttgttctatatttttaagaaaaaattccttgttacaacgaattttttttgcccaaatataggaatatacctgagggacggcggaatggcttcataaaaaagaaaaagaaacacagaagggaaaaggtgaatatatgaaagcatttcttatattagaagacgggactgtctttaccggaaccagtatcggttcgacaaaagacatgattagtgagatagtgtttaatacttcaatgacaggttatctggaggtattaaccgacccttcttatgcgggacaggccgtagtaatgacctatccattgattggaaattatggcatcacaccggatatggagtcaaggaaggcatggccggatggatatatcgtaagagaactttccagaatgccaagcaacttccgttgtgaaggaacaattcaggatttcctgaaagaacaggatattccgggaattgcaggaattgatacacgtgcccttacaaagattcttcgtgaaaagggaaccatgaatggaatgatcaccaccaatgagaattataatttagacgagatccttccgaagctaaaagcttatacagttggtgatgtggtatcaaaagtaacatgtgatgaaaaatatgtcttagaaggcaatggaccaaaggtagctcttatggattttggtgcgaaaaagaacattgccaagtctttaaatgaacgtggctgtgaagtaacagtctatccggcaggtacaaaggcagaagaaatcattgcttctgaaccggacggtattatgttgtctaatggacctggagatccggagacatgcgtatctattatcgaagagatcaagaaattatacaatactgatattcctatttttgcaatttgtcttggacatcagcttatggcacttgcaaatggcgcaaagacttataagttgaaatatggacaccgcggcggtaaccatccggtgaaggatctgaccaacaacagggtttatatttcttcacagaatcatggttatgcagttgatggtacatcaattgacccgaaagtagcaaaagaagcgtttatcaatgttaatgacggaaccaacgaaggacttgcatatgaaggaaagaacatttttacagttcagttccatccggaagcttgtccgggaccactggattccggatacctgtttgacagatttatggatatgatgaaaggagcaaaataatgcctagaattaaagatattaagaaagtattagtaattggctctggtcctattatcattggacaggcagcggagtttgactacgcaggtacacaggcctgccgttcgttaaaagaagaaggtctggaagtagttctgctgaactctaatccggctacaatcatgacagataaagatatcgcagaccgcgtatacattgaacctctgacagttgaagtagtagaacagctgattttaaaagaaaaaccagacagtgttcttccgacacttggcggacaggcagcgctgaacctggctatggaacttgaagagaatggattcctcaagagaaataatgtacgtctgatcggtactacttccgagacgatcaaaaaagcagaagaccgtttggaattcaagatgacgatggagaagatcggtgagccttgtgcagcttctaaagtcgtaaaggatgtgcagacaggtattgaatttgcagaaagcatcggatatccggttgtacttcgtccggcttatacacttggaggaagcggcggaggaatcgcggataatagaacagaactcgtagagatcctggaaaacggacttcgtctttcacgtgttggggaagttttggtagaacgttgcatcgcaggatggaaagagatcgagtacgaagtaatgcgtgacagcaatggtaactgcattaccgtatgtaatatggaaaacctggaccctgtaggtgtacataccggagacagtatcgtagtagcaccttctcagacactgagcgataaagagtaccagatgctccgtacatctgctcttaatattatcagtgagttaaatatcactggtggatgtaacgtacagtatgcgttgaatccagattcatttgagtactgtgtaatcgaggttaaccctcgtgtaagccgttcttctgcacttgcatctaaggcaacaggatatccgattgccaaggttgcagcaaagatcgctcttggatatacactggacgagatcaagaacgcagtaacaaagaagacatacgcaagtttcgagcctatgcttgactactgtgttgtaaagatcccgagacttccatttgataagttcatcagtgcaaaacgtacactgacaacacagatgaaagcgaccggagaagttatgagtatctgtgataacttcgagggagcacttatgaaagccatccgttctctggaacagcatgtagacagccttatgtcttatgacttctctcatttaaaaggagaagaactgttagaagaactgaaagttgtagatgaccgtcgtatctggaaaatcgcagaagcaatccgtcagggcatcagctacgaagacattcacagaattacaaagattgacaactggttcattgacaagatcgcaattcttgtagagatggaacagaaattaaagacagaagaattaacagcagagacattaaaagaagcaaaacgcttagagttcccggataatgtgatcgcagaactgacaggaaagacagagcgtgagatccatgaccttcgtcatgacaatggcatcacagcttcttataagatggttgatacctgtgcggctgagttcgcagcagagacaccatattactactctgtattcggaagtgagaatgaagtagttgaaacttccggcaagaagaaagtactggtacttggttccggaccgatccgtatcggacagggtatcgagttcgacttctgttctgtacattgtacatgggcatttgccaaagaaggatacgagacgattattgtaaataacaaccctgagacagtaagtacagacttcgatatcgctgacaagctgtatttcgagcctctgacaccggaagatgtagaaagtatcgtagatctggaaaaaccggacggagcagttgtacagttcggtggacagacagcgatcaagctgacagaatctcttatgaagatgggtgttccgatccttggaacatctgctgaaaatgtagatgcagccgaagaccgtgagctgtttgatgagattcttgagcagtgcgagatcccaagaccgacaggtggaactgtatttacagcagaagaagcgaagaaagttgcaaacagactgggttatccggtactggtaagaccttcttacgtacttggcggacagggaatgcagattgcgatcaatgatcacgatattgatgagttcatcggaatcatcaaccgtatcgcacaggatcacccaatcctggttgataagtatttacagggtaaagagatcgaggttgatgccgtatgtgacggagaagatatcctgattcctggtatcatggagcatatcgagcgtgccggaatccattccggagacagtatctctgtatatcctgcacagagcatctctcagaagacaaaagagacgattgccgaatatacaagaagacttgcaaaatccttacatgtaatcggactgattaacatccagttcatcgtatgtggagaagatgtatatgtaatcgaagttaaccctcgttccagccgtactgttccatacatcagtaaggtaacaggtattccgatcgtaccacttgcaacaaaagtgatcatcggacacaagatcaaagaacttggttatacacctggattacagccggaagcagattattttgcaatcaagatgccggtattctcatttgagaagatccgcggtgctgatatcagccttggacctgagatgaagtctaccggagagtgtctgggaattgccaagacatttgatgaggctctttataaagcattcatcggtgccggagtcaaacttccaaaacacaagaacatgattatgacagttcgtgatgaagataaggaagaagcagtagagatcggacgcagattcgagaagatcggttacaagatctttgctacagaaggaactgccaaggttctgacagatgccggagtaaaggctatgacagtgaataagatcgagcaggaatcaccgaaccttatggatctgatcctcggacataagatcgacctggttatcgacacacctccgcagggagctgatcactcaagagacggattcgtgatccgtagaaatgcgatcgagacaggtgtcaatgtactgacagcgatcgatacagcaaaagcactgatcaccagtctggagaatacagacattcagaaactgacactgattgatattgctaaagtttaatcagattgaaataatcagctgagtgaatacaccctcatataggacgaaaaagtcctgtatgagggatttttttatacaaaaaaacgtggatcatggcaagaaagtaaataaaaaagttgacaaaacactgcacacatgatatgataccaatcgttgctcgtaacaaaattgtaatatttgtaataatgttgcaaaaaatgcatatactttattaaaagaaatgtaaatcattgcaacaaaatcaggagggtatttatattatgttaaaagcgaagagactgaaatcaatgttcgtgctgtattcggcatgtgcagtaatggcaactggttttaccagtcaggcagcctctgaacggccggaagtaacaacaatcacagagacaaaaaaggaagatgtgaatacgcataccgctgtacagacaatatcacagaatatcgttgcatctgcacaggagatgacagatgcaagtcagcaggtgatcgcagaaaatatagcaaaaaaagaagaggaagaacgtattgcaagagaaaaagcagaacaggcggcaagggaacaggcggaacgcgaagcaagagaagcgtatgtaagagcgaatcaggaactaatggcatccatcatctattgcgaagccggtaatcagccatatgaggggcaggttgccgtaggcgctgttattatgaaccgtgtcaaaagtggaagctatccggattcgatcgaagcggttatctatcagtccggacagttcggaccggcagcaaccggatggttgaacagagtcagaagttcaaaagggtattcacagacagctctgcaggcggctgtggatgcgctgaacggatcaaacccaatcggaaactgtctttattttgatcagggcggttctgggatgaagataggagcacattatttccattaatatttgcagaaatcctatagaaagaaatgcatatggaatgtagccggagttcttcggaaattcgaaagaaatcttaagaaagctggaattgacaattgtattacgaatgtattacgataagagggcaaaagtttttaacttttgtcctttattaattgttggggagaagaaagattgtataagattttaatcgtggaagatgatgagacaatagcaggcggtctgaaaaaccatttgggaaaatggaattatcaggcagagtgtatgacagattttaaagacgtgatgggaaaatttgtggactttgatccgcagcttgtgttattggacattgtacttccattttttaatggatttcactggtgtcaggagatccggaagatctcgaaagtgccgatcattttcctgtcatcggcgaatgataatatgaatattgtgatggcaatgaatatgggtggcgatgaattcatcgagaaaccgtttgacctgaatgtggtgacggcaaaggtgcaggccgtgttaagaagaacctatgaattccgtggaacggcagatatcatggagtggaatggtgcgatcctgaatctggcagatgcgacagttttgtatcaggatcagaaacaggaactgacgaagaacgaatttaagatcttgcagatgcttctggaaaatacggggaagatcgtaagccgtgaaagtattatgacaagactctgggacagcaatgaatttattgatgacaatacattgacggtcaatgtggcaagactccgtaaaaaaatggaacagattggccttggcggaaaaattatcacaaaaaagggaataggatatatggtggaggcatgaaacttttaatagcatttttaaaagataaaacaagagagatcagcctttatgccggaacggtcggaatatttattgttgtagcatttctttataatatcaggatggatgcgttgaaatatgcactgctgctggtgatattgtggctgctcctatatgtaataacggaatatcatcgcttccggaagaagcatcttctgctggaacggtttaagaagagcacgcaggaatgcacaaaagaacttccagagtgcaggaatcttctggaactggattatcaggaattactggggatctttgacgaaaagattctggagttgaaatcagaggcaagaatcaaaggccaggacttaagtgattattatggtatgtgggtgcatcagatcaagacacctatcgctgcgatgcacatattgctgcaatcggtggaagatgaaaatccggcactgccggaattaaaagagatgaagatggaactttttaaaatggaacagtatgtggagatgctgctgacgtatctccgcatggaagatatgtccggggatctgcagtttgagaaggtatctttggataagattctgaaacaatctgtccggaaatattctcagatgtttattcttcagaagatccgtctggattaccggccggtggaacgaatagttcttacagatgaaaaatggctggagtttgtgacagaacagattctgtctaatgctttgaaatacacaaagaatggcggcgagatcagaatctgtctggaagaaaaaagaggacgggagtgtctggtgatcgaggataatggaatcggtattcaggcagaagatcttcctagagtatttgaaaaagggtttaccggatataatggaagagcagataagaagtctacagggattggactgtatctttgcaaaaagatcatggataagatgggacataagatatggattgattcagaggtgggaaaaggaacccgtgtatatctggaattgacaaggcaagaatggaatccggaataacgatcagacaaaaagagaaaaccttacaggaatgtaagattaaacaggggaaatgtcacatgcttcgatggcaggatatttcctctttttttataatagataccgtaaagaagaaatcttaaaaagaaaggaagaaaaacttatgtcattactggaagtaaaaaatgtgaagaagatatatacgactcgttttgggagcaatcaggtagaggctttaagagatgtgaattttacggtagaacgcggggaatatgttgcaatcatgggagagtctggatcgggaaagacgacgcttctgaatattctggcggcacttgataaaccgacagaaggaaaggtttatttaaaagacagggatctgggaaaattaaaagaaaaagagatcgcaacgttcagacgtcagaatctcggatttgtatttcaggattttaacttgttagatacattttcattaaaggataatatattcctgccactggtattatccggaaagaaatatccggagatggaaaagagattaaaaccgattgcagaaaaacttggaattgaaaaactactggagaaatatccatatgaggtgtccggtgggcagaaacaaagagctgcaattgcaagagcgctgatcacgaaaccacagctgattcttgccgatgaaccttcgggagcactggattcgaaagcggcagacagtctgatgaatctttttacaacgattaaccaggaaggtcagacgattgttatggtgacacatagtgtgaaagcggcgagtagtgcgaaaagggtgctttttatcaaggacggaaaagtattccatcagctttacagggggaatcttacgaacgaagaaatgtatgaaagaatttcagatacgctgaagattcttaccacaggaggtgaggaggatgaataatttcatctatgaaaaacttgctgtgaccaatcttaagaataaccgtaagacctatgtaccctatatctttacaggtgttctgaccgtcatgatgttctatatcattgacgcactgagcaagggggaaggtattacccagaatacattgaagatatgtcttcagtatgcaacgggtgtgatcattgtatttgcagtgatttttctgttctatacgaatagtttcctgatcaaacgacgaaagaaagagatcggagtatacaatattcttggaatgggaaagcggcatattgcacgaatgatggcagttgagacgatcctgacggcgggaatcagtattcttggcggtctggtgtttggaataatatttgggaaactgatgtatctgctgctccttaagattctgcacaatagcgtagatatgcagttttcggtcaatgggactgcaattgtacagactgtcatattatttgcaggaatttttcttctgacgtatttatataacattttacagatacagctggtgaatccggtggaacttctgcacggaggcaatcagggggagaaagagccgaagagcagatggctgcttgtgatcgtcggtgtggcggcactgggcaatggttactggattgcacttacaacagaggcaccgttagaagcacttttgaaattctttgttgcagtggtctgtgtgattattggaacttatgcactttttattgccggaagcattgtggtattgaaaatactccggaaaaataaagcttattattataatccaaagcattttaccagtgtatcaggcatgatctatcgtatgaaacaaaacggagcgggacttgcgaacatctgtgtgttaagtacgatggtgctggttatggtatccacaacggtatctttgtatgcgggaatggaagatatcctggactcacgttttccgagagatgtttcaattgtctgcaatgaagccgatacaaataaggaagagactcttcagagactgataaaagaacaatgtgagaaagcaggggtaaaaataacagacagagtccggtacagatatggcagtatgaatgcggttttgaaaggaaataatctggaaaaggtagagcagtactatccggacaatcatttttactatgtagagatgatcacacaggaagagtataaccggatagaaaaacagaatgtttcgttaaaggaacaggagatactgacctataccacgaacggcaaatgtggaaaaaaacagataaacattgcaggacagaactatcaggtgaaaaaagaactgtccgagatgacgagccagccgaagagcacggcagaaatgtataagacattatacattgtatttgctaatgcagagcagattgaacgtatcgagtcattttcttatgcagataaattcaacctgaagggagatgacggaaaacaaaaagagacactggaacagatacagaacgaattttatgaaaagtttccggatggaacgatggaaagccgtatgttaagccgttcttctttttatgaattgtacagcggactgttctttattggaatctatctgggaagtatgtttattatggcaacggtactgatcatttattataagcagatatcggaaggctatgatgacagggagcgttaccagatcatgcagaaggttggcatgagtaaaaaagaagtgaagcgttccatcagaagccaggtcttaagcgtattcttcctgccgttggttgtagcagtgattcatgttgcagtagcctttaaagtaatgacaaaaattctgggagtattaaatcttacgaatgtatcgttgtttgcggtatgcacaatcattacgatagcggtgtttgcggtattctatatcatcgtttacagtataactgcgaaagaatattaccggatcgtgaattaagattaagggtttaccattgactttgtatctttcaggttgtattgttgttttagaatgttttacgaatcaaggaggaacttaaaaatgacaagagaaggcgaaagagaactggtaaaagtggaacatgtaaatggcggagacggttatattgtaagagaagcaatggttacttcggaagaagttggagaagcctgtaagatgtatgccaagattcatctggatccgggatgtgaagtaggataccattatcatcatggtgagacagagtcttacttcattctgaccggacacggaacttatgacgataacggcgaaaaacagccggcaaatcctggcgatttgttcctgtgtaaagacggagatgcacatggaattaagaacaccggtgatgaagaacttacctttatggcattgatcttaaaaaaataatattggaaaatatgaaaaacacctgtctgtaacttggatcatttcaggaatgatatcgggccgcagacaggtgtttgtattgccatgcattcggaagaagctgccggtggcaggttctctgtattgattataatgaacggaatacatccagcagccggtcattatcctctggattcataatgcagaaccgtacatattctccgttcaggctttcgaaagaagaacagtcccggatcatgagattctggtgaatcgccttttcaaagacatcgaaagaagtgagtccttcttttaaaatccttacaaggacaaagttggcataagcaggataaatttttacggtatccagtccggaaagctctgtgcacattcgggtgcgctcggaatcaatgagagtccaggtcttcttaatataatcggtatctttcaacatccgttctccggcataagctccgacactgttcaggctccacggattctggtgggtaagaagcgtctgaagaaatgcctgattactggtgagaccataaccaaagcgaagtccaggtgcggcgaagaacttggatacaccgcggatgaccatgaagttgtcgaattccggtacaagagaaactgcagagagggaagtgccttccggtgcgaattcgatataagtctcatcgatcataacgaagataccaagtgatcggcatacggttaacagctttttcatatcagcggtactgatggctgaagaggtcgggttgttcggattacagatgatcagaagatcaatatcacttttcagtgtatcggtcagatcggaaatatccagtctgaaatcctgttcttctttcagattataatattccagtgtgccgccgaccagattcagctctcttgcatattcggaataggtcggtcccagaagcagcgctctttttggtgcgcgctggctgatcagaagtgagataagctccgtagaaccatttccgacaacaatatgttccggcgaggtattggtatatgcagcaattgcttttttcagatctgtataatctctgtctggataactgctgatgatatccagatgttctgcgagatctttttttacctgtccggataatccgagagggtttacatttgctccaaataaaatgatattttccttgttaaggtgataataatctgcgatcttttccagatcgcttccgtgaaattctggcttttttttcatatttttcatcctatcgacacatttttgatattttctctttacggcattgctattcattgacaaacaatgctataatttattatagtatgttttaagaaaaaagcaacgaaagaagcaggtgtaggacttgaaaaataaaatccaaaaattttcaaaaggcgactttcagttgatacgacctgatgttatattcgatgagaccaatctggtactcattataggtgaaggggaagtatacagaggaagttttacaatgagggcaaacaatgagggaaggatacgaggactggtgtactcgtcttctttccgcgtccattttaaagatcagggatttgaggggaatccggcaagagtggaatttacgtatgacggacggggacttcgcccgggacatgtagaggaaggaaaattcacggtcgtatgtaccggcggtgagtttgaactggcttttacggcaatcattgagaaaccatatgtgatgacaacctatggaaaagtacagagtaccgatgatttccgcaaacttgcaattaaggatttttcagaagcgggaaggctcttccgttccaaagaattctatgagattttaaaatatgagaatgagcgtacattctatctgtacgataatatgcgcaaatggtctctcggagaacaggccatggaagaattcatggtagggatcaaacagaaagaatgcattttccttacgcttcagggagagggaatgctattcgaagatctgacagagtcgacaaagggaacactgactctgatgaaaaatacatggggatatatgccgattcatattgagacagtcggtgattttatccgggtgtccagacctgagatcagcacagaagattttgtgggaaatgcacatgagatcgaatatgtggtaagagcagagaaacttcatggcggacggaattacggagcattgaagttcgtgacaccatacgagacactcacttatgaagttgaggtattgcagaatcaggagtatgacgaagatcacaggatgccggaacttttactggctcagatcatcaaagaatatgtaggatatgtggcaggaagagtgacactggaacactgggtggatagtgcggtcgagaagatggtagcactgcgtaagctggatcctctgaatgaagtatatcagttgatgcttggtaatatctatctgctcggaggcaagacggaagaagcaaaatggattcttgagaattacaattataatcggttcgcaatcggaaaagatccgctgacaaactgttattatctgtatctgactgcaaagatccgcggagatgtgaactatgaagaacgggtgctggatgaggtcggaaagacatatatgcgtcatcaggattcctggtggctgctctatatgatactgaatcttgacaacagatataagaatccttataaacgtctggaagttctggaacagcagtttgagtatggaatccatgcagtaatgttctatttggaagcatatctgtgctatcaggaaaagccgacacttcttaagaaattaggcacatttgagattcaggtgttgaattttgcgaccaaataccgcatgatgacaaaagaactggcactttatatttcaaattttgccagtcagcagaaaaaatacagtgacaatctgttcagaatcctggaaagaatctataagatgtatgaagagccgatgatactgaatacgatctgtacacttttgatcaaaggaaataaaacggcaaagaagtatttttcatggtatcagaaggcagttgattcggatcttaagattgcccagctttatgaatattatatgatgacaatcgacgaagacagtgcgcacggaccgttgccgaaatcgctggttttatattttatgcatggaaatgctctcgattataagaaggctgcgtatctgtatgcaagtcttgtgatccatgaggaacaggcaggagatctgtatctgaattacagagaacagatggtggcatttacatgggaacagttggaaaagcgccatataacagaatcactgcgtacattgtataaaagattttgcagagaagacgagatgacggcagaacgtatggaggcgatgcgtgacatctgttattcttatgaagtaaggacaaaggtacgcgggatgaaatgtgtgctggtaattgaaaaagatggttcggtacgtcagcgtatcccgtatgatacgaagaatggagctatcatttatctgtatgataaggaatcgagaattgtatgggagtctgtagagggcagacattatacggattccattccatatgagacgaaaagactgttttatgagccgcgttttgtagatatgtgcagaaaatatgcagcatctacaggattctggaatcaggagccggagaaagaaaaaccggattatgaaaagatccaggcaaaggggatagattcatttgaggataaggatgttttcctggtttgcagcagaagaatcagggaagaaaattatacggaggatgacttcttaagttatcttgcttttgaaatgttccggagaggacagtatgacaaggtgacacttacgtatcttgcggagtattactgtggtgcaatcggagatatgaagcggctctggaaagtattaaaacaatatggggttccgtcttataaggtcagtgaacggatcattacacagatggtcttttcggagacattgtatgaggaagagcatatttttgaagattattatctgtcggacaatgtatatttccgcttaaaacaggcatatcttgcttacgttacaagggaatatatcgtgtatggacgaagtctggaaaaatgtgtatttgaaatcattgcaaatgaatgtgatcagaaagaagatctgccggatgtatgtaagattgcacttctgaaatattattcagataaagaatacacaggtgaactggaagatgtccttcatcaggtactacgggaaatgtgcgaaaaacaactagtcttcccatattatatgaattataaagaggaatggctgcgggaagtacaactctataataaggtgatggcagcataccgctgtaaaccgggaggaaaagtaagactgtactataagatgaaacaaaaagaccgggaagaactgggataccgggcagaggcaatgatgccggtctatgaaaacctgtatgtaaaacaatttgtcctttataatgatgaatcagtgaattattatttccaggaatccggaaacggagaaatgatcacaacagacaagaagacgctgaaaacagataaagaacgtgtatttgccggaaaatatcagatgctgaatgcaatgacagatatggattcggatgcggaacgttcgaaagccatgcttgagtttgaagaagaagaacagatggcagatcagatatttaagatatattaaaatgaaaggaggagacgataatgcaaaaaggaagtgttctgggctatgatctgaatgaaaagaattgtcagatcagttattatgatgaaaataaagaagaaccggaaacgatggaagcagcagttgataattatcagattcctctgatccttggctattataaagaacgatgggtatatggacaggaagcaaaacgactgagagaagcgggagagggagatattgtcactcatctgttccgtaaagctgtaaaaagaaaaaaagtacgtgtaggcgggaaaatccatgatggcgtatggcttcttgcaaagttcatttccatgacattgaagaaattcgaacagattgattatattacgttttccgttccgtatacgaatgttgatatgtcgaagatgttaaagggaatcggaaaatatatcggtgtaccgggagaatgtgtatttgtacaggattataaggaaagtttctgtcagtatatgttttatcagccgaaagaattgtggcaatatgaatcagcattgttttattgtgatgcgcaggaaatccgtgcatatatgctgcgccgcctgaatacagtaagcaccaagagcagggatatgtttgtgacagtagaagaagtcgccaatgcgcacatgaaagaactggaagcaatctatcctgtgctgaatgtagataaagccaaagatgcggatgagagttttaagtctttcatccagaatgtatttgataaaaaagtggtatcgtctgtttatctgacaggagaaggatttgagaataactggtatccgaattccctgaaggtactgtgtaacggacggagggctttccttggaaataacttatacagtaagggtgcatgttattcatccatgcgctatgcagatccgtatgatgatggtccgatttatctggatggaacaaagatgacagaacagatctgcctgcgtatgagaattggcggacaggaaggatggtatccgattgttgcatggggaacacactggtatgaggcagacggacagtgggaagtgattttggaagatacatcggatattgagatccatatagagacacttgacggagaggatcttaaagttgagacagtgtcactggaagaactgccggaacgaacagattattctttgcgtcttcagattgaagtcatgtttatggatgagcgtacctgcaggctgcgttttaaagatgttggtttcggagaattttatccggcatcagatttccttgtagaaaaggaattacatttaggaggtatcaatgggcagtttaattctttgtcataaaaaacgggccaaacgaccttttgaaatatccagagttcatatgcggatttacacgatagaagaattgtgttattacatctgtaataatctgtatctgatcgattatacgatcgtcaatgaacgattgtgccggtgggtcggggatgaactggaactgccgaagctggcagaggaattaagaaggcttcttcgggagaatggatcgatggaagaatttgtacttacgatcctgaaggaatctaatatctatgccgcggcagaaattcataagatgcagagtgttctggaacaactgcagtcacagagagacgtagaaaaagaaaaatataaggcggatacgcttcaaaacagtaaagaatacgaatcagcgattctagtatatcagtccatccttaacaaagactgggatgaatcggtagataaaaagttttacggtcgtgtgtatgcaagcatgggatctgcatatggtcatcagttcctgtataaagaagcggcaaaggcttatcaggaagcgtataagatatgtgaacagcctgatatattgaaggcgtatctttatagctgttataaagctcttccgcatgatgaatacttaaaaatgctgtcggggaatccaatccttctgagtctggacactattttgcgtgatgaaatggaaaaaacaaagaaaaagataggtgcggatattccgaaagaaaagctgaatgaatggaaaaaggagtaccgcaggattgacaaacaccgtggaatatgataatatatccaaagattttagtgtggtaaagtaatcaactgctaaactggtaaaagagcgtagcggctgtttggcacacgtaaaaggaatacaggaggatatatgttatgaaaaagagattagtactgctccttgttacggcaatggcagctacaacggtattggcaggctgtggaagtaaagattcaggttcatctgacagtggaaagaaatcggcaaaagaatcaaaagtagaaaatgatgatgacacattgatcgttgggtttgatgcttctttccctccgtatggttataaagatgatagcggagaatatgtaggattcgatcttgatcttgcacaggaagtatgtgatagaaatgattggaaactggtaaaacagccgatagactgggattctaaggatgcggaactaaattcggaaacaattgactgtatctggaatggattcactatgaatggccgtgaagatgattatacatggtcagatccatatattgacaacaagcaggtcgtggtagtcagaagtgattcgggtattgatgacttttcggggctgaaaggaaaacatgtagaagtacagacagactcttctgcacttgcggctctggaaggagatcagaaggacctggcggcaaccttcgcagatcttaatcaggttgcagaatacaatacagcattcatggatctggaatccggtgcatgtgatgcgatcgctatggacatcggagttgcaaactatcaggtgaattcaaggaaaaatccggatgattacaagatcctggacaaagaaatttcatctgaacagtatgcagtcggattcaaaaaaggaaacacagagctgaaagataaagttcagaagacactggatgagatggctgaagatggaacggttgataaaattgcagaaaaatatgcagattacggagttccgggagctctttgcataggaaagaacagcaagtaaaatgaaggggccaaccccggaggggattggtcccttttggctcgccattcattcggaagaagcgtgaaaaaactggaggacattatagatggagataggaacactgataagagaacttggcggaggaatgtgggtctcggcagagatatttattctgacattacttttttcactgccgcttggactggtggttgcattcgggagaatgtcgaagattgcaccggtcagatggatatcaaaattatacatatcgattatgagaggaaccccgctgatgcttcagttgatggtagtgtatttcggaccatattatctgtttggaatgcgcatttccacaggataccgtatgactgcggtgctgatcggttttgcaattaattatgcggcatattttgctgagatatacagaggcgggattgaggcaattccggtaggacagtatgaagcggcaaaggtactgggatattccaaaagccagacatttttccggatcgtatttcctcaggtatgtaagcatattctgccggcagtgaccaatgagatcatcacgctggtaaaggacacttcactggcatttgtgctggctgtaacggagatgtttacaatggcaaaacagattgcggcggcacagacttccatggttccgtatattgcagcaggtatcttctattatgtatttaatttgcttgttgcgatgattatggaaaagattgaagaaaagttgaattattaccactaggaggaatagatcatgagtctgcttgaaatgaaaaatatcaaaaaaagttttaacggggtcgaagttctgaaagacatttctctgaaggtggaaaagggagaagtccttggtatcatcggtccttccggctcgggaaaatcaacccttcttcgatgtgcaacggggcttgagactgcggatgcaggggaaatccattattccggaacctttggactggtgtttcagaattttaatttgtttccgcattattcggtgatgaagaatatcactgatgcaccgctgaaagtgcagaagagaaagaaagaagaagtctataaagaagcgagagaacttttgaagaagatgggacttgccgacaaggaagatgcatatccttgtcagttgtcgggaggacagcagcagcgtgtatcaatcgcgagagcacttgcactgcatccggatattctgttttttgatgagccgacgtccgcgctggatccggaactgactgcagagatcttgaaagttatcagggaacttgcgatggagcatatgacgatggtgattgttacgcatgagatgaattttgcgagaaacgtatcggatcatgtaatcttcatggatggaggtgtgatcgcagtagaaggaactccggaagaagtgttcgattcatctaatgaaagaatgaaagaatttctcggaaaattcaatgattaaccgcgggaaaactaatgaatagagcgggtttataagctgtgcttattaaatgacgcgttataaataatgtatcagcaggaatacaaggtagatggaaatattgcttttccgtttgccttgtattatactgatatagcaaaatgctttttaaagacagttttgacaaatgaaaaatttgaaaagaatggagtctgcatttatgagtgaatttgaaaaagtaacaacaggactgggtgaagaatgcggtgtgtttggagcctatgatatggatggcggagatgttgcaccatccgtttattatggactttttgcattgcagcacagaggacaggaaagctgtggtattgcggtaacggatacatatggagaaagaaaagtacattccaagaaaggacttggactggtaaatgaagtgttcgatgaagagtctttacaggaattgaagggaaatcttggtgtcggacatgtaagatattcgacagcaggtgcttccagagctgagaatgcgatgccgttggttatcaattatgtgaaagggatccttgcaattgcacataacggcaatctgacaaatgccattgaacttcgccatgaactggagtacacaggcgctattttccagacaacgattgactcggaggtgatcgcatatcatatcgccagagaacgtctgaatgtagagaaggcagaagatgcggtaaaaaatgcgatgaagaagatacagggagcgtatgcactggttgtcagttcgccgagaaagatgatcggtgccagagatccgtttggattgaagcctctttgtattggaaaaagagataatacttatttcctggcttcggagagctgtgcgattgctgccgtcggaggagaatttgtaagagacgtagagcctggagagattgtaagttttacaaaacatggaatgaaatcagataaaactatggcaatcgatccaaaaaagcaggcaagatgtatttttgaatatatatatttcgcaagaatggacagcgtgatcgatgatgtgaatgtatatcatgcgagaattgttgcagggaaagctctggcagaatcttatccggttgatgcggatctggttgtcggagtaccggattccgggctggttgcggcgaaaggatattcggaacagtcgggaattccgtatggcatggcattccacaagaacagttatgtcggaagaacatttatcaagccaaaacagagtcagcgggaaagcagtgtgaagatcaagctgaacgtgatcgaagaggttgtaaagggaaaacgtattgttatggtagatgattctattgtacgaggaacaacctgtgcgaacattatcaagatgctcaaaaaggccggagcgaaagaggtacatgtaaggatcagttcaccaccgttcctgcatccatgttatttcggaacagatgtgccttcgaatgaacaactgatcgcacattcccatacaacagagcagatccgtgagatgatcggggcagattcgcttggctatatggaagttgataaattaaaaaacatggtcggtgatctggcatattgtgacgcatgcttcaccggtaattatccgatggaagtacctggaagagatgtttcgctggcatttgaatagaaaacaggttaaaatagtcgggtggaagaattgacgaaggagattattagtatgagtaatgacagatatacaagtccactttcagaaagatatgcaagcaaagagatgcagtatattttctcgccggataagaagttccgtacatggagaaaactctggatcgcacttgctgaaacggaaaaagaactgggactggatattacagaagaacagattgaagaattaaaagcacatgcagatgatatcaattatgatgtggcaaaagaaagagaaaaggtagtccgtcatgatgttatgtctcatgtgtatgcatatggaaaacagtgtccgaatgcaaaaggaatcattcatcttggtgcgacttcttgctatgtaggcgataatacagatatcattctgatgtcggaagcgttggagattgtcagaaagaaactgatcaatgtgattgccgaactcgcaaagtttgcggatgcatataagagtcttccgacacttgcatttacacatttccagcctgcacagcctacaacagtaggtaagagagcaacactctggatgcaggaattcatgatggatctggaagatctggaatatgtaaaaggaagtttaaagcttctcggatcaaaaggaacgaccggaacacaggcaagctttctggaactctttgacggagatcaggagacaattgataagatcgatccgatgatcgccaaaaagatgggatttgagacatgttatccggtatcaggtcagacctattcacgtaaggtagataccagagtggtaaatgtacttgcaggtattgcagcaagcgcacacaagatgtccaatgacatccgtctccttcagcatctgaaagagattgaagaaccatttgaaaagagtcagatcggatcttcggcaatggcatataagagaaaccctatgagaagtgaaagaattgcttcactttctagatatgtgatggtagatgccatgaatccggcaatcacatctgcaacacaatggtttgagagaacgcttgacgattctgctaacaaacgtctcagtgtcccggaaggatttctggcaattgatggtatcctggatctgtgtctgaatgttgtagacggactggtagtatacccgaaagttatcgaaaagagactgatgtcagaacttccgttcatggcaacagaaaatatcatgatggatgctgtaaaagcaggtggagacagacaggaacttcatgagagaatccgtgagctgtctatggaagccggacgcaatgtcaaagaaaaaggattagacaacaaccttcttgaactgatcgctgcagatcctgcattcaatctttcgctggaagaactgcagaagacgatggatcctgcaaaatatgtgggacgtgcgccgattcaggttgatgcatatctgaagaatgtcgtgaatcctgtgctggaagcaaataaggatattcttggagtaacagcagagatcaatgtataagattctgtaacaaataaaaacatgaaaaagaaagtggagtttcagtgagcaatggaacatcactttcttttcttgtatatatgatttataataaatccatatggaagtataagggggaagaaagcggatatatggaaaaggctatggaaaagattaagaatatgaagaatggtacagcgtcagaaaaacaataccgggtcagaaggtgcagatatacggatctggcaatggtacttgtgatcgcagtttccatacagtgtttcacgaggctggaatatgcaggggaaagatatattcaaagccggaacgggtataagatagccggcggcataatggaaggctgcggacggaaaaatgtaaaaggatatgtggaaataaaagcatcgtgtgtttcgaatgcgaagaatataatcgaaaatttgtgcgctcaggcagcggcaccgaatcgaacaattatgaatgtgaccacatcaacagatgatgccggaaaagatgacagccgaattacaaagctgcctgctgcagaagagatgaacacgtctgcttcggaagatggatctgagattttgaaagctgaaaagaatgcggacgctgcacttgttgcggcagatacaacaactgcggaagcagcggttgagagcgctgaagaggacaagagcagcacagaagaacagcagagtggtatgctgaatcttgatggatttatcataggagaaaatggcatgatcgaatgttgtgagaacccgtctctggctgccgaggatggaattattatattgccgtcagacgacagatgtaagggaatcggagcagaagcattaactggaattacgggagtggaagaaatctatattccggccaatattacatggattgaacccggagccctggaaaaactggaaaatcttatgtatatagaggttgcaccggacaatccggcatatcaaagcatagatggagttctttacagcaaaaaggagcagaaagaaaaggcatgaatattcgacagataacagacggcaaagaagattatatagaattgcttcgtatgggagatccggatgaatccagaatccgtaaagtattggaagaaggtgaactctttttacttgaagagcatggaaaactccgtacattgtgcgtggttatattttcggaagaaaagaaatgtgagataaaaaatattgtaaccatagaaaaagaccgaggcaaggggtatggccggtatatgatccattatatctgtgaacattactgctcacagtatgactggggatatatgaaaaaagaccgatgccgggacatcatggaattctgtgaaaaatgtggattcacagatgaagatgaggtatatctgaaaaaggaactgatgtcggaaatcgacacaaaacgtgtaattaatcttgcaatggaagcaggaagaatgcttttgaaaaacggaggcgagatctttcgtgtagaagagacgatgatgagaatctgtcgtagattcggggtgaaatatgtggagctgtttactttgagtcatggattgtttatctgtgcaggaacggataaagaaaagttgtatacaaaagtaaaacaggtaccgctttcctctacacatcttggaatcgtagcagaagtaaatgatctgtcccgggaaattgcagcaggacatgtcggaattgaagaagcaataaagaagttaaagaagatcgacaagatgccggtcaagcgtattccttatcagatagcggcggcgggattaagcgccggtggattgggttatctgcttggcggaacatcaatggaagcatttgtggcattttttgtcggctgtgttgtgttttcatggtcactttttgccggaaaacacggtgtttcaaagatcctggttcacattgtaggcgggatcattattgcctctatggctttggcagcaatgcagattccgtttttaggggaacttaggatggaagggatcgtgaccggcgggattatgccgctggtgcccggacttgcatttgtgaatgcgatccgtgatctggcggacagtgattatcttgcaggtacagttaaaatgattgatgcggttatggtatttgtttatattgcaatcggtgtgggaacggcgttgtcggtatatcatcatgtgttaggaggcattttataatgatcataaaaattatagcaaatctggcatgttcatttatcgggacgattgcatatgcggttatgtttcaggtgccgaggaggttctatatcggatgcggaatcaccggatcggtgggatggatgatgtacaagtttgcgtctgtatattgttcggttgcagctgcgtcctttataggaacggtatgtgctgtattggttgcgagaatgctgacggtccgcctgaaatgtccgatcactatctttatgatttcgggtatcattacactggtgccgggagctggcatctattttacagcgtattatctggtgacaaatcagtttgcaatggctgctgcgaaagggatcggagcaataaaagtagcttttgggattgtgcttggaattgtctgcattgtatctgtcccgagagaagtgttccagaaagaatactgggttgaaagaaagattgcaaaacaacagaaaaatggaaagagggatccggtaaatcttccgggtgaaagacacagatgaaagatctgatataaaaggttgctgtccgccttggatttgtgctacaatgtagagacggatagtgttctaatgtatgtagcaatacatagatttcatacatttcaaaataataatgaaataggagataatgacagttatgagtaaggtaagaacaagatttgcaccaagtcctacaggaagaatgcatgtaggaaacttaaggacagcgctgtatacttatttgatcgcaaaacatgaagatggagattttatcctccggattgaagatacagaccaggaacgttttgtagagggcgcactggatatcatttatcgtacattgaaagagaccgggctggttcatgatgagggtccggataaagatggcggggtaggaccgtatgtgcagagtgaacggaatgcacagggactttatttgaaatatgcagaacagctgatcgaacagggggatgcttactactgcttttgtgacaaagaacgtctggaatctttgaaaagcaaagtgtctgacgaggatggcggaacagagattgttgtatatgacaagcattgtctgcatttaagtaaagaagagattgaagcgaaccttgcagcaggaaaaccgcatgtaatccgttttaacatgccaacagaaggaactactacattccacgatgagatctacggagatatcacagttccgaatgaagaactcgatgacctgattttgatcaaatcagatggatatccgacttacaacttcgcaaatgttgtcgatgatcatctgatgggaatcacacatgttgtacgtggtaatgagtatttgtcatctgcaccaaaatataacaagatttatgaagcattcggatgggatgtgccgatatatgtacattgcccgctgatcacagatgaaaatcataagaaactcagcaaacgctgtggacattcttcttatgaagatctgatcgagcagggatttgtgacagaggcagttgttaattatgtagcactgcttgggtggtcgccggaaggcaatcaggagatattctcactggaagagctggtaaaggcatttgacttccaccgcatgaataaatcaccggctgtatttgatcttggcaaattaaaatggatgaacggtgaatatatcaaagctatggattttgataagttctatgaaagagcggaagggtatatccgcaaagttattacaaaagattatgacctgaagaaaatcgcagcattggtaaaatcacgaattgagatcttcccggatattgcagagcagatcgacttttttgaagcagtaccggaatatgatacagcaatgtattgccataagaagatgaaaaccaatgaagaaaattcactggaagtattaagagaagttcttccgcttctggaagcacaggaagactatagtaatgatgcactgtttgcgcttcttaagagttatgttgacgagaagggtgtaaaagtcggttatgtaatgtggccaatccgtaccgctgtatcaggaaagcagagtacaccgggtggagccacagagattatggagattcttggaaaagaagaatctgtaaaacgaatcaaagacggaattgaattattaagcaagtaaggggattctatgagtttaaatcatgctcagacagaggcagtcgcccataatgaaggaccatgtatggttctcgccggccccggatcggggaaaactctaaccattgcaaagagaatagaatatctgatcatgaagtataaggtaaggccagaagaaattctggtcattacctttactaagtatgcagctcaggagatgaaagaaagaaccagacggatctgtggtccgtcttcttatgctgttacattcggaacgtttcacggaatctattacggaatcctgaaatgggcgtaccgtctggaaccatcgaatctccttacggatgaagaaaaatatcggatgttaagaactcttctgccaaaagtcggatgggatcaggaaccggaaacggatgaagaaaaagactatttgcaggaactggccgcagaaattggaaatgtaaagaataattgtatggctattgaagcctatgaaccggtaaaatatacaacagaaaaattccgtgcactatacaaagattacgaagaagaaaagaaaaaatgccggaagattgattttgaggatatgctgatccagtgcagggatctgttttttaattatccggatattctgaaaaaatggcaggataaattccggtatattctggtagatgagtttcaggatgtgaatcaggcacagtatgatgtggttcgtatgctggctgaaccgcagaataatctgtttgtagtgggggatgatgatcagtcggtatatggatttcgtggagcaaagccgggaatcatgatggaatttatgaaagattatccaaaggccaagagggtacttttggatattaattaccgcagcagtgcttatattgtcaatggtgctttaagagtgatcggtaataataaaatccggtttgaaaaaaagatcgaagcgtttcagaaagcagatgaaacagttcatgttcaggaagtaaaagaccctgtgcaggaggcagaatatgtgctggaaaaaataaaggaatgtcaggaaaaaggtattgcttatacagatatagctgtgttgtaccggacgaatatagatgcaagggcaatgtcggaacttatgatggaatatcagattccgttcgtgatgaaagaacatctgaataatatttacgaacattttattgcacaggatatcagcagttattttcacctttcacagggggaatatagccggaaatattttttgcagatcgcaaaccggccaaacagatttttctcaagggatagtatgaaaggcggaacagttacctatgattcgctcagagaatattaccgggataaaaactggatgacggacagagtggatcagctggaatgggacatgaagatgataaaagacaaaacaccatatgcagcaatccaatatatccggaaacatatgggttatgatgagtttttaaaagactatgcggcataccggaagatttcagtggaagatctttttgcggtgctggaagagatatggcagaattccaaaggatatagaacgatcggtgactggtttgaacatgtagaacgatacggggaaatattaaaggagcagaattgtaaaaaaaatgcggcagagggtgtgaatctgatgacaatgcatgcggcaaaagggctggaatttgatacggtatttgtgatcgaggcagatgagggcagcagtccgtataagaaagcagtgacggatgaggaaatcgaagaagagagacggcttttttatgtagcaatgaccagggcgaagagaaaactgatcatcagttatgtaaaagaaaaaaacgggaaagatatgactccttcccgttttgtgtccgaattactcttcgacgtctgattcatcaaattcctgggaatccatccattcatcaaaagcatcagcggcaatttcgtattcgtcatcatcttcgatgttgccgagatcgggttcgccgtcctcggtttcattgtattgatagagataaacatcaccggcttcattaggttcaagattctcatccagaggaagcagggcaatgtattctttgcctgcagcttcatatactgtgaggattgcacattcaatgatctcatcgttatcgagtgtaagttctacggttgtgtagctttcagtttcctttgtgtcgctcatatcatagtctcctttactaacattaaaacttatcttaactttaacaaagaaacggataaaaagcaagatgatagtagtcaaacgggtaaaaatgttgtagaatgtagctgtatgtaacgcaataataaggaggaataacaacatgatgaagaagagaatgttaggagtgattgcagtattactcgtatgcattttcgcattatctgcatgcaagaaagaggctggaaagccggtggataatgcagtcagtgagaatacaacagatgattcggaggatacggatcagacagaagacgcaggaaagtacaagtttgggttctctgtgatcgatatgcagaatccatattttataacattggaagaagctgcacaacagatcgtagaaaaagaagaatgtaccatggtggtaaaagatccggcatctgatgcggatacacaggcagagcagatcagggagatgatcaacgaggggatcaatgcaattttcctttgcccggtcgattgggagaagatcacaccttcgcttcaggcattgcaggacgcaggggtaaaaattattaatattgattcacaggtaaaagacacagattatattgatgcatatgtgggctctgataatacagaggcagggaagctttgtggcaatgatctgattgaaaagtatccggatggcggtacagttgcaattctggaggctacgacacaaaattcggtgaatgaccgtattacagggtttgagcaggcagttgccaaggcggaaaaagggtttgaagttgtagcgagagaagatacaaacggaacatttgacagtgcgctggaagcagccaagaagattttggaggaacaaccggatgtgacggcaatcatgtgtggaaacgaccagatggctgttgcagcaaagacagcactgaatcttgcgaataatgatcagactgttgtctacagtgtagatggttcgcctgatattaagaaggaattaatgaaagcggatagtcagatcgcagggacagtcgcacagtctccgatcaatatcgggaaaaaagcagtcgatattgcattgaatgttcttgacggaaaagattttgaagcagagacggcaatagacgtatttatgattaataaagataatgttgaaatgtatggcgcagacggatggcaataggcgcagacgggcaacgggaaggacataacagagatgagagaggttcaaggatatccattaccactgggggtgcagataagtaaagacagggttaatttttccattgcagttccggcagataaggactgccaactgttattataccgcacagggagaaagaaaccgtgcaggcagtttgatatgaaaccaatgatcggtgaagtgaggtgtatagcacttgaggatatcgagccgggagattatgaatacaattatctgatcaataaagaagttgtaactgatccgtacgtaaaagcaattgccggcaaagaacgctggggtgtaaaaaaggaactgtcagaacatgagatccggggacggctgcagatgagtgattatgactgggaaggagatcatacattacagataccttatcatcaggtaatagcgtacagtctgcatatccgcggatttacaagacatctatcatcaaaagtaaaggcgaaaggaacttttcagggagtaattgaaaagctggaatatctgaaagatcttgggatcaaccagattcattgtatgccggtatatgaatttgaagaatgccagatatatagaaattactggggatacggtgcgggaagctattttgcacccaaaagcgcatattctgcagatggagacggcgccagaggactgaaagatatggtgaaggcatgtcatcggtccggaatagaggtcgttctggagatgccattctgcacggctgcagataagatgatgatgttagaatgtctgaggtattatgttatggaataccatatagatggatttatattaaatccgtttgtgatttcgacggagagtgtgcatgcagatccgtttttgaaaaacaccaagattatggaacacgagttgggattccagacagtcatgcgaagatttctgaaaggtgacgaagggatgatccatgacgtgatctactggctgaaacaccattcaaaagagcagggaatctttaactacattactgatcagaacggatttaccctgaatgatctggtgtcttacgatgcgaaacacaatgaggagaatggtgaacataatcaggatggaccggattataattatagctggaactgcggggcggaaggaccgagcaggaaaaaggcagtaatggaactgcggaatcatcagatatttaatgcatttttcctgctctttctggcacagggaactccgtgtatgcttgcaggagatgagtttggaaattctcagaaaggtaataataatgtatactgtcaggataatccgataggatggacagattggcggggactggaaaagaagaaagaactgcatgattttgtaaaagaactgattgcattccgtaaatcgcatccgattctcacaccggagcgagaactgcaggggatagatcttagctgttgcggtgtgccggatgtatcttatcacggggaagaggcgtggcagataccgggggaagtgtcgagcaggcaattgggcgtatattatagtggagcacagacaaaaagcgaggactgttatgttgcatataatatgcattggctggaacatgtatttgcactgccggctttaccaaagggatatggctggtatgtgaaagcgacgacggaacgggggatgttagatgtgccggtgcttttgaaagatcagagaaaattagagttaaaagagcggtcggttacggtgcttacagcagaacggattgtggaggttgaaacgaagaaaaatgaagacattacaacacttacagacgatcaatcatcataaatatcttgttatgaaggaatgctttaaagtaggactttacagacagggacttcttcatgacctgtccaaatattcaccgacagaatttttagttggatgcaggtattaccagggaaatagaagtccgaataatgctgaacgggaggcaacgggttattctaaggcatggttacatcataaaggacgtaacaaacatcattatgaatattggatcgattatagtgtagatccgggggaaggtatcataggccttaagatgccgcttcaatatgttgtggagatgttcatggatcgtattgcggcatctaagacatatcagggggacgcatacagagacaatcatccattggagtattatgagaagggagccgggcggcttggaaaaatgatccatccggatacagcaggccttctgcacgaattgttgaaaatgctggcagaagagggagaggaaaaaactttccggtatattaagaaagtccttttgaaacagaagaaatattaacagtttatgcaatagttcaaaaaaataaaaaaattcaaaaaaactgttgacacaataacaattttgatgtattatatatcttgtcttcgcgagagagcaaagatgaatgcggaagtgtcggaactggcagacgagcaagactaaggatcttgtaagcattgcgcttgtgtgggttcaagtcccatcttccgcagttattttttgagagtaacgaagactgaaaattacatactgaatatgcggaagtgtcggaactggcagacgagcaagactaaggatcttgtaagcattgcgcttgtgtgggttcaagtcccatcttccgcattcatctaaaagatggaaacccttgatttgctttgggtttcttatttttttgcatactaataattttttctgattaacgataaggaattttaataaaaaagagaaaaattaaaggaaatcaaaaagttttgtcgaataataataatgaggagattcaaaatgtattattctgatgagattatcgaagaagtaagatcaagaaatgatattgtagatgtaatatctacttatgtaaaactgcagaaaaaaggcagctcatattttggcctgtgtccgtttcacaatgaaaagtctccgtctttttctgtcagcaggcagaagcagatgtattattgttttggatgcggtgccggaggaaatgtatttacatttttgatggagtatgagaattatacatttgtcgaggcactgaaatatctggcagacagagcaggggtagaacttccggaggaagaatactcgaaagaggcaaaagaacgtgcggatacaagggcgattcttttggaaatcaacaaagctgcagcgcaatattattacgtgcagcttaagagcagtcaaggagccataggacttggatattttaagaaaagacagctcagtgacgagacgatcaaggcatttggtctgggttattcgaataagtacagtgatgatctgtaccgttacttgaagtcgaaaggatataaggatgacatgattgccaaagcaggactgatcagtattgatgaaaagaatggtgtgtatgataagttctggaaccgtgtgatgtttccaattatggatgtcaatagcagggtaatcggatttggtggtcgtgtgatgggagatgcaaaaccaaaatatctgaattcaccggaaacaatggtttttgataagagccggaatttgtatggattgaacagggcaagacgtaccaagaagccatatttccttttgtgtgaaggatatatggatgtgatttcgcttcaccaggcagggttcaccaatgctgttgcgtcattgggaactgcgctgacaccgggacatgctgcactgatccgcagatatgtacaggaagtgtatctgacctatgacagtgacggagccggtacaagagcagcattaagagccatgccgattttacgagatgcagggattactgctaagatcataaggatggaaccgtataaagatccggatgaatttattaagaatttgggagcagagaaattcgaagaacggattgcaagtgcgagaaatgtatttatgtacagtctggaagtgctggagaaggagtatgatatgaattcgccagaaggaaagacagagtttatgaaagaaacggcgagaaggctgacacagtttgaagaagagattgaacgcaataactacatagaagcagtggcgaaagcctatcatgtcggatttgaagatctcaggaaactggttggaaagatggcggtacaggcaggacttgcaaaaccggttgaaagacccagggagatacagaataacaggaagaataaaaaagaagatggaattctggtgtctcagaaaatactgctcacatggctgattgaaagtgaagatatctttcgacagattgaaaagtatattacaccggaagatttttcggaagggcttttccggcaagtggcagaacttttgtatgaacaatatgaaaagcatgaggttaatccggctcagatcatgaatcactttacagatgaagaggaacatcggcaagtggcaggtctgttccatacgaagatcaaagaactgacaactgtgaaagaacaggaaaaggcattgcaggagacaattctacgggtcaaagatcacagtattgaagaagcgacgaagaatctggatcctacagacattcagggactgcagcgcctgatgaatgaaaaaagaaaaatgcaggatctgcggacactgcatatttccattaattaaggataaaatataaacaagcaatgagaggatggacactacatggacgaaaatatcgtaaaattccaggaaaagttaagagaacttgtatcacttggaaagaagaaaaaaggaatcctggagattcaggaaatcaatgattttttctctgatatggaacttgattctgatcagatggaaaaagtattcgattacctggaaacaaataatgttgatgtgctcagaatcagtaatgatgacgatgatataccggatgatattgtgatgtcagacgaagatgatattgatgtggagaaaatcgacctttcggtgccggatggaatcagcattgaagatccggttcgtatgtacttgaaagagattggtaaagtaccgcttctgtcagcagatgaagaagtagaacttgccaagagaatggcagagggcgatgaagaagcaaagaaaagactggcagaagcgaatttgcgtctggttgtaagtattgcaaagcgttatgttggacgtggtatgttattcctggatctgattcaggagggaaacctgggtctgattaaagcagtagaaaaatttgattatcacaaaggttttaaattcagtacttatgctacgtggtggatcagacaggccattacgagagcaatcgcagatcaggcaagaacaatccgtattccggttcatatggtagagacgatcaataaattgattcgtgtatccagacagttgttgcaggaattaggacgtgaacctacgccggaagagattgcggcagaattagatatgccggtagaaagagtaagagagattttaaaaatttcacaggaaccggtatcattggagactccgatcggtgaagaagaagatagtcatctcggagactttattcaggatgataacgtgccggtaccggcagaagcggcagctcagacacttttgaaagagcagttggatgaagttctagatactctgactgagagggaacagaaagtattgagattaagattcggtatgaacgatggacgtgcacgtacactggaggaagtaggaaaagaattcgatgttactcgtgaacgtatccgtcagattgaggcaaaagcacttcgcaagctgcgtcatccaagccggagcagaaagttaagagattatttagattaagaaaagaggcgcctatggaactatcaaagagactgcaggcagttgcagatctggtgacagagggcgcttctgttgcagatatcggtacagatcacggctatattcctatttatctgatagaacatcatatagcggagaaagtgatcgcactggatatcaacagaggtcccttggagagagccagaatgcatatagtcggccatggactgaaagaaaagatagaaaccagactttcggacggattggaaaaagtccttccgggagaagtggatacgatgattgctgccggcatgggcggcggtctggtgataaaaatcctgatggaaggaagaacggtagcagatgcgctggatacaatgattctgcagccacagtcggagattggaaaagtcagacgatttttgaatgaacatcggcttcagatcatagaggagaatatggtagaagaagatgggaaattttatccgatgatgaaagttatacatggagaaaaagaagagtatactgtatgtgaatatacatatggaaaatgtctgctgaagcagcggcatccggtactcaagaaatatctggacagggagatggcaattaaggagcatgtattcgggcagctttttaaacatcagaacagtaagagtgctgccagaagaatggaagaactgaaaaaggagatcatactgacgcaagaggcattgaagtattacgagtagaagaaagggagtatgtaagatgttgtgtagagatgtaatgaatgtaattgaaaaagaatatccgctgaattacgcactttcatgggataatgtcggacttctggtggggagagacgataaagaagtgaaaaagatatatatcgcactggatgcaacagatgaagtaatagatgaagcggttaagaatggtgcagatatgctgattacacatcatccgatgatcttttcaccgatcaagaaaattcataatcttgattttgtaggaggtcgtattcttaaactgattcagaacgacatttcttattatgcaatgcatacgaattatgatgtactgggaatggcggaactttccggagacaagatgaatatgaaagacgctgagatactggaagtgacggcagaaggtgatatcggggaagaagatgagccggaagggatcggcagagtatcagatcttgagattcctatgacgctcagagagtgctgtgaggatgtaaaagatgcatttcatctgggagcagtaaaggtgttcggtaatctggaagacaaagtgaagcgtatagcaatctgtccgggttccgggaaaagtgtgatccaggcagctctggataaacatgcagatgtactgattaccggagatatcggtcatcatgaaggaattgatgcagtggcacaggggctggcaatcatagatggcggtcattatggaatcgagcacatttttattgaagatatgagacagtatctggaaaagaatctgaaagatgtggacgttattgcggctccgatcattcatccgtttctgcttgtgtaaagatgagaaagtctgtgagccagaggcaaaatgagatgagaaagttatgaaacggccaaagtaaaagtgtgaaaatgaggtgtgtctatgaatgatattttatatacggtccatgtagatggaacagacaaaaaattcaaaaaaggaacgacatatcaggagatagccagaacatatcagcaggaatatcagcatgatattgtgctggtatttgtggatggacgacttcaggaattgttcaagacactggaaactgattgtgagttgaaatttgtgacgactgcggatccgctgggttataaaagttaccggagaagtatgagcctgatgctcgtgaaagcaatttatgatgtgacagaacataagaatatcgataaagtcagaattcattattctgtaagtaagggttattattgcacgatagaaggaaatattgatcttacacaggaatttcttgatcgtgtagaaagccgtatgagagctatggtggaaatggatcttcctatcagaaaaaaaagcgtgcatacagatgatgcaattgcaatgttcggacagcatggcatgcacgataaagaacgtctgttccattaccggagagtgtctcgggtgaacatttacagtttgaatgaatttgaagattattattatggatatatggtaccgagtgccggatatctgaaatattttaaattgtacctgtacgatgagggatttgtgattcagatgccggtgatgaatgagccggaagcagtacctccgttcgaaccgcagaatcacttgttccgtgtgctgcaggaatcaaccaagtggggagatattcagggtatcgaaacagttggagacctgaacgacaagattacaaaaagtgatgtgaacgaattggtattggtgcaggaagcacttcaggaagaaaaaattgcacagatcgctgaacagatcaaagagcgttcggatgtacgctttgtattgattgcaggaccatcgtcttcgagtaagactactttttcacatcgactgtctgtgcagctgcgggctaatggattgtgtccgtatccgattgctgtggacaattattttaaagaacgcgaagagacaccaagagatgagaatggagaatttgattttgaaggacttggtgcggttgatgtggaattattcaatcttcagcttcaggaactcctggagggaaaagaagtcgtaataccggagtttaactttgtaaccggtcataaggaatacaaaagaaggccaaagaaattaaaagaaaacgaagtgctggtaattgagggaattcattgtctgaatccggaattgaccagaaagcttccggatgaaaataagtttaagatttatatcagtgcacttacacagctgaatattgatgagcataaccgcatcccgacaacagatggacgtctgatccgcagaattgtacgcgatgcaagaaccagaggtacatcagcaaaggagacgatccgtatgtggccggcggtgagaaaaggagaagagaggaatatttttccttatcaggaagaggcagatgtgatgtttaattcagcattgatctatgaacttgcagtattgaaaccatacgtagaagctcagctctttggaattgaacgagactgtccggaatatttggaagcaaaacgtttattgaaattccttgattactttgttggaatcggaagtgagaatgtaccggcgaattcattacttagagagtttatagggggcgggtgttttcacgtgtgattttttgggatttaatttattaacggggaagcggcttctcagtccttgaagaaaacaatagataaggcttcttgttcaggttccataccataagaaacactaagagagtcagaagcacctaaaagcaaaggaactacgctcaaactcggcgttcgcctcaaacacgttcgcttcgttcctttaacggtgcttctgactctctaattgtttctaacggcattccacattcacaataatccttatctattgtttccttcaagtcgtgactggctgcgaatgttaataaatgaaatgcccggaagtgtaacccggtggaggccactacggttacgcaattgccatttaattcttaaggcatttgatacacacggaataaaacttggaaaggcgttccagtgaatgtgaaagaggcgttggtaattcttaaggggtaaaattctgcgttaggttttcaaaatttgactgtctgaggcgtatgccgagtttcaaattttgaaagcctgcttttagcagaattttgcccctttagaattgacccgccgatggaacctgagcaggaacgcctttccaagttttattccggttcgggtatccacagccttcctgaattaaattccaagatacacttgtttcatatattcaatccgggaactcatattttgcatcaggagatctacaagtgtaacggcagccatggattctaccacaacaactgcacgaggaacgataactggatcgtggcgtccggaaatctcaatttcaatattttcaccattagtgttcactgttttctgcggctgggaaatagatggagtaggctttatggccgcacgtaaaaggatcgggcttccgtcactgagacctccgagaattccgccgctgtgattggtcagtttggatatctgcccgttttcagcgaagaatgagtcgttattcttacttcctttagaagagacgacagaaaatccatcgccgatttcgacaccttttacagcaccgatggacatgactgcttttgcaagagcggcatccagtttgttaaataccggttcaccgataccggatggcatgccgtgaatcatgcattcgatcagtccaccggaagaatcctgttctctgatacaggattcgagatatgcacttgcctgttcagcatatttctgatttggcatataaagccggttctcgttaattgcagagtaatcatatgcatcagaaggaatagaaaaaggtccgatagctttggtgtaagtggtaagatgaattccgagtgcttcaagaatccggcaggcaattgcaccgccggcaacccgtccgatggtttcacgcccggaagtacgtccgccaccgcgatagtcacgcactccgtatttctggtcgaaggtataatcagcatgtccggggcggtaacagtctttgatcttgctgtaatcatgagaacgctggtcagtgttgcgtacgataagagaaatcggtgttccggttgtatatccttcaaagacacccgaaagaatctctacgctatcggattcctttcttgctgtggtgaatttgctttgtccgggtttcctgcggtcaaggaatgtctgtatataatcactggtaaggggaatgcctgccgggcatccatcgacaacaacaccgagtgccggaccatgggattccccccatgttgtaatagtaaataaagttccaaaagttgatcctgccatatcatagtctccttaattatgtattagtcatcgtgaatataataatctataaagtattatatataaaaagaaatgaagccgcaatcataaaatgtgtataaaatatcctgtaaaaaaataagaattagactgtactttttgatatatgcatattataattagaaagcatgaatcttatagaagtagaatattcatatagaggagttaagattaatgagcagaaaagatatgcagtcagatgagattgaagaaataatgaaagaaatgctgaacgatgatgagtatgcagatgagggatttgaggatattgacagagaagataaccggcatgaatcgaagaaagcaatgaaaaaagagaaaaaagcagaaagaaaatcaagaagaaaaaagcggaaaatgagcaataaagtagcgattgccctttcgctgattgtggcagttatagcaatcggatatgtggcaacagcggtattttacagcacacattttttcgcaaatacagaaattaacggagtggactgctcaaataaaagtataaagcaggtggaagcttatctggagaagcaggtttctgattataatcttactttgaaggaaacagaaggaaaaacggaagaaatcagcgggcaggatatttctttgaaatatgtggaaggaaagcaggttgagaaacttgtgaagagccaaaacccgtttatgtggccggaagctttttggaaatccagaaagatggaagcaaaaataggtgttgaatacgatgaaagtgcattgaaagcactgattgcaaatctggattgtatgaaagaagaaaatcagacggaaccggttaatgcacatccggaatttcagaatgataaatttgtagtcataccggaaaccgacgggacaaagattgatacagatacattcagggaaaaagtaatcactgctgtagatggattgaatgcggagatggatctttcgaaagaaggctgctatttaaaaccggcatatactgctgaatcaaaaaaagtgacagaggcctgtgatgcaatgaataaatatctcggagccatggttacttatgattttaaaccaaacacggaagtggtggactcgtcaatgatatcccagtgggtaaaagtagatgatgatatgaatgttacgtttgatgataacgctgtcaaagaatacattcagtcacttgcggcaaaatacgatacaaaaggaaaagaaagaacatttacatccgcaagtggtaacactgtcactgtttctggtggaaactacggttggaagattgaccagaatgcagaatataatgcgttgatcgcgaatattcagaatgcagaaacagtaacaagagaaccgaattattcaagccgcgctgcaagtcatgagggcaatgatgtgggaaatacttatgcagaagtaaatctgacaacacaacatatgtattatgtaaaagacggccagattgcactggaaacagatgtagtaacaggtaatcccaataaaggaaacgatactccgacaggagtatattcactggcatacaaagccaaggatcagactcttaggggaacgaaaaaagccgatggaacatatgaatatgaaacgccggtaaaatactggatgccatttaatggaggagtgggattccacgatgcatcatggcagccgacttttggtggaagcagatatctgacaaatggttcgcacggatgtgtaaatatgccaccggagatggcaggaaagctgtttgatctgatttcggcaggcacaccggtagtagtacataattagagaaaaggaaatagaacatgtatgaattaataaaaaaagatggtcttgcaaaaaggggaagactacacacagtacacggggtcattgagacacctgtatttatgaatgtgggtactgcagcggcgatcaaaggtgctgttgcaacctcagatcttcaggagataaagactcaggtggaattgtctaatacatatcatttacatgtgcgtcccggagatgaagtagtaaagaaactgggtggacttcacaagtttatgaactgggacaaaccgattcttaccgactcaggtggatttcaggtgttttcacttgccgggcttcgcagaattaaagaagaaggcgtatattttaattcgcatattgatggaagaaaaatcttcatgggaccggaagagagtatgcagatacagtcaaaccttgcatctacgatcgctatggcatttgatgaatgtccatccagcgttgcagacagggattatatggaaaagtccgtagcgcgtacgacaagatggctggtacgctgcaagaaagaaatggaacgtttgaatgcacttccggatacgatcaataagcatcagatgctttttggtattaatcagggcggtgtgtatgaagatatccgtatcaaacatgcagatgaaatctcaaaactggatctggatggttatgcagtcggcgggctggcggttggtgaatcgcatgaagagatgtatcgcattctggatgcggttgttccacatcttccggataataaaccaacttatctgatgggagtcggaactccggcaaacattctggaagcagtcgacaggggagtggatttctttgattgtgtatatccaagcagaaacggaagacacggacacgtgtacacaaaccatgggaaactgaatctgtttaacgccagatttgagctggatgccagaccgattgaagagggatgtcagtgtccggcatgccgtaattattcgagagcatatatcaggcatctgctaaaagcaaaagagatgcttggtatgcgtctgtgtgtccttcataacctttatttctataatacaatgatggaagaaatcagagatgcaattgatcatgactgttacaaagagtataaaacccaaaaaatcgctgctgtaacaggaaagaatgaataaaataatgaaaaaagcataaaaaaccttgctgaatgcgaggtttttgtgtatgatagcaatagtgtttaaagataagtaggaggaaaagagatgttttcattagcagcacagagctccagtggtacaagctgggttattttaattgttgtatatgcagttattttcggaggattctacatgatttttatgagacctcagaaaaaagagcagaaaagagttcaggctatgatcaacgagatggaagttggcgatacagtactgacaacgagtggattttacggtgtgcttattgacatcagtgatgaagatgtgatcgtagaattcggaagcaataagaactgccgtattccaatgcagaaagcagcaatcgcacaggttgaaaaggcttctgcagaataaaagatgaacgtagagaatctgttgtgtgcaggttctctttttttctttttgtacacggaaatgtcagaaaacaaaatagtacatatatgtgaaattgtgttggaataaatacaaaataacagtgtattgttcatataaatatacacaaattgcataaaattgcatacaagcgtgatattgaaaacgattatcagaataaggcttgatattttcttcacgaaatgttatactgacggcgcagaagaaaatgaaagataggaaaggggaacaaagaaatggcacattttgaacagtgggctggttttaaaggaaaagaatgggtaaattctgtagatgttcgcagctttatccaggagaactacacaccttatgaaggagacgaatctttcctggaaggaccaacagaagcaacagatattctgtggggtaaacttcaggaacttcagaaagaggagcgtgcaaaaggcggcgttcttgatatggagacagaagtagtatccggacttacagcatatggacctggatacattagcgaagagacaaaagatcttgagaaggtcgttggtcttcagacagacaaacctctgaagagagcttttatgccatatggtggaattaagatggctgagcaggcttgtacaacttatggttatcagccgagcgaaaagcttcacgagatttttacaaaatatcataaaacacacaaccagggagtattcgatatctatacacctgaaatgaagaaagcaagacacaataagatcatcacaggtcttccggatacatatggaagaggacgtatcgttggtgattaccgtcgagtagctctttatggtatcgacttcctgatcgaaagaaaacagtatgactttgagcgttatgcaagacacggaatgaaaggaacagatttccgtctccgcgaagagcttgctgatcagatcaaagctctgaaagaaatgaaagaaatggcagctgcttacggttatgacatttcacagccggcgaaagatgctcatgaagcagtacagtggctgtacttcggatatcttgcagcaatcaagactcagaacggagctgcaatgagtgttggacgtatctctacattccttgatatctatattgaaagagacttaaaagccggaaagattacagaaaaagaagctcaggaattaattgaccacatggttatgaaattccgtatggttaagttcgcaagaattccatcttacaacgaactgttctcaggagacccgacatgggcaacactggaagttggtggacttggacaggacggacgttctatggtaacaaagaatgattaccgtttccttcacacactgaagaacatgggaccttctccagaaccaaaccttactgtactttactcttcaagactgcctgaaaacttcaagaagtttgcagccctgatctcagtagagacaagctcaatccagtatgaaaatgatgatgttatgcgtccggtatggggcgatgactactcaatctgctgctgcgtatctgctacagagacaggtaaagagatgcagttcttcggagctcgtgcgaaccttgctaagtgtctgttatacgccatcaacggtggtattgatgaaaagaataaaattcaggttgcacctgcttacagaccaatcacatctgaatatcttgacttcgatgaagtaatggaaaaatatgatgctatgatggaatggctgagcaaactgtatgtagatacactgaatatgattcactacatgcatgacaagtattactatgaagcagctcagatggcattgattgatacagacgttaagcgttcatttgcaacaggtatcgctggattctctcatgtggtagattcactttgcgctatcaaatacgcaaaagtaaaagctatccgtgacgaagatggaatcacaacagatttcgagatcgaaggagatttcccaagatacggtaacgacgatgatcgtgcagacgacatggctgtatggcttctgaagacattcatgcacaaactgaataagtgccatacatacagaaattctgtacctacaacatcaatccttacaattacttccaatgtagtatacggtaaggctacaggatctcttccggacggaagaaaagcaggagagccactttcaccaggtgctaacccatcttacggtgcagaaaagaacggacttcttgcatcccttaactctgttgctaagcttccatacgagctggcactggatggtatttctaatactcagacaatcagcccaagtgcacttggacatacagatgatgagcgtaaagaaaatcttgcacgtgtaatggacggatacttcgatcagggagcacatcacctgaatgttaacgtatttggtacagataaacttattgatgctatggagcatccggaaaaaccagaatatgctaacttcacaattcgtgtatctggatacgcagttaagttcatcgacctgactcgcgaacagcagttagacgttatcgcaagaacttgccacgatcatatgtaaaagctatgagccatgcatcagatgagacagatgttataatcaagcttgcttgaattatgatatctggatcagatgatatacggcgacagccgtcagcgagatgaagcaaagcggaatcgagctgcgcatggcggagtacatggcgaattacatgtaataaataaaaaaaggagcaaagctatgaccaaaggatatattcattctctggaaagtttcggctccgttgacggtccaggtgtccgctatctgatctttacgaccggttgtgctatgcgctgccagttctgtcataacccggacacatggaacatgaattcagggactctctacacagcagatgaactgattgataaagcctggaaataccgcacttactggggaagtaagggcggtattaccgtcagtgggggcgaaccgcttctgcagatcgattttctgctggagttgttccagaaagcaaaagaaagaggaatcaacacaacactggatacctgtggaaatccattcacaagagaagagccattcttcagtaaattccaggaacttatgaaggtgacagatcttgtaatgctggatatcaagcatattgatgatgagcagcataagatccttaccggtcagacgaataagaatattcttgatatggcagaatatctttcagagaccggaaaaccagtctggatccgtcatgtactagtcccggaaagaagtgataaagacgaatatctgcacagacttcatgattttattgagacgttagataatgtggagaaagtagaagtccttccgtatcatacacttggcgtatataaatggaaagaactggggattccgtatcagttggagggcattgatccaccatcgcaagaacgggtggaaaatgcgaaccggattcttgaaacagcaaaatatcatgcataaaaactgtggaacacatggaaataatgtgttccacagttttttatagcaatcaatcatcaaagtgtacaagaaatattataaaaagcgttttttaagtaggtaaaatgtagcaatttgtcaatttaaccaattaaagtcttgaaacatgtataaaaatacgataatattatttttatagatttttaccgaaggaaggaagaagaacgatgaatcttaaaattggtgtgattaagggagacggaattggtccggagatcgtaacggaggcaatgaaagttctggataaagttgcaggagtatatggacatacttgtgattatacacagttactcatggggggagcatccattgatgttcacggagtgcctcttacagatgagacaatcgcagaggcaaaagcatgtgatgcagttctgatgggttccatcggaggagatgcaaagacatctccgtggtataagttagagccgtctaaaagaccggaagcaggacttttgaagatcagaaaagccctgaatctttttgcaaacttaagacctgcagtactttatgaggaattaaaaggtgcatgtcccttgaaagaagagattacagaaggtgggttcgacatgatgatcatgagagaactgactggcggtctttactttggagagagaaagacagaagagattgacggagtgatgacagcaaaagattctcttacatataatgaagaggagatccgaagaatcgcaaaacggggatttgatattgcaatgaagcgacgcaaaaaagtaactagcgtagataaggcaaatgttctggattcttcaagattatggagaaaagtggtagaagaagttgcaaaagattatccagaggtggcagtggaaaatatgctggtagacaactgtgcaatgcagcttgtaaaagacccaaaacagtttgatgtcattcttacagagaatatgtttggagatattctttctgatgaagcaagtatggtgaccggatctatcggaatgcttgcaagtgccagcttaaatgagacaaaattcggtttgtatgagccgagcggcggatcggcaccggatatagcaggaaaaggaattgccaatccaatcgcaactatcctttctgcagcaatgatgctgcgtttcagctttgatcttgataaagaagcagatgcaatcgaagcagctgttgcaaaggtgttaaaagacggataccgtacgattgatattatgtcagaaggaaagacacagattggaacagaagagatgggcgatctgatttcagaaaacattcgttaattgtagaattatatatagataagaagtatttgacagaaagaaaacaggaggataaaaatgagaagtgatacagtaacaaaaggaaaacagcaggcacctcaccgttcattgttcaatgcacttggactgacggaagaagagatgaacagaccactggtaggcatcgtatgttcttataatgaaatcgtgccggggcatatgaacctggataaaattgcgaatgcagtaaaacagggagttgccatggcaggtggtacaccgatcatgtttcctgcaattgcagtttgtgacggaatagcaatgggacatatcggaatgaagtattctctggtaactagagacctgatcgcagattctacagaagcaatggcgatggcacatcagtttgatgcgttagttatgatcccgaactgtgataagaatgtaccgggacttctgatggctgcagcaagaattaatgtaccgactgtatttgtcagtggcggaccgatgcttgcaggacatgtaaaaggacagaagagaagtctttccagtatgtttgaggcggtaggagcgaatgcggccggaacaatgtcagatgcagacctgtgtgaattcgagaataaagtatgtcctacatgcggatcatgttcgggtatgtacacagcaaacagcatgaactgtctgacagaggtacttggtatgggacttcgcggaaacggaacaatcccggcagtatattcagaaagaatccgtcttgcaaaacatgcaggtatgaaagtcatggaacttcttgagaagaatatccgcccaagagatattatgacaaaagaagctattctgaatgcacttactgttgatatggcacttggatgctctacaaacagtatgcttcatcttccggcaatcgcacatgaagtgggaatggattttgagattgatttcgcaaatggaattagtgaaaagacaccaaatctctgtcaccttgcaccggcaggtcctacttatatggaagacctgaatgaagcaggtggtgtctatgcagttatggcagaactgaataagaagggactccttcatacagaatgtatgacagttacaggaaagacagtaggagagaatattgaaggagtagtgaacaaagatccagaggttatccgtccgattgacaatccatatacaccaacaggcgggcttgcagtgttaaaaggtaatcttgcaccggatggaagtgttgtaaagcgttcggcagtcgtagatgagatgctggtacacgaaggacctgcaagagtatttgactgtgaggaagatgcaattgcagcaatcaaaggtggtaagattgtagccggtgatgttgttgttatccgttacgagggaccaaagggaggtccgggaatgcgcgagatgttaaatcctacatctgcaatcgcaggtatggggcttggatcgagtgtggcgttgatcacagacggacgtttcagtggagcatcaagaggagcatctatcgggcatgtatctccggaagctgctgtcggcggaccaatcgcactggtagaggagggagacctgatccagattgatatcccgaatctttctattcatctggatgtatcggatgaagaactggctaagagaaaagaaaactggactccaagagagccaaaggttacaaccggatatcttgcaagatatgcggcaatggttacttctggaaacagaggcgcaatccttgaagttccaaaagcaaaataaaaattatgacaggggaatgaatggtatgcagttaacaggatcacaaattgtaatcgaatgtttgaaagagcagggagtggataccgtattcggttatcctggcggagcgattttgaacgtatacgatgaattatataagcataaagatgagattaaacatattcttacatcacacgaacagggtgctgctcatgcggcggacggatatgcaagagcaacgggaaaagtcggtgtatgtcttgcaaccagcggaccaggtgcaacgaaccttgtaactgggattgcaaccgcatacatggattccattccggtggttgcaattacctgcaatgtaggagtagcacttctgggaaaagacagtttccaggagatcgatatagcaggtgttacgatgccgatcacaaagcataattatattgtaaaggatgtcaataacctggcggatacaatccgcaaggcatttgtgatcgctaaagaaggaaggccaggtccggttctgatcgatattccaaaggatgtaacagctaataaagcagaatttatatcacgggaaccagagattgtaaaaccgtccgaagatatctgcgaagaagatctggaaagtgcagttcgcatgatcagggagtcggaaagaccatatatatttgttggcggcggggcaatattatcaggagccagcaaggaattatatgaatttgtaaagaaggtagacgcaccggttacagattccctgatgggaaaaggtgcattcccgggaacggatccgctgtataccggaatgcttggaatgcatggcaccaaaacatccaattacggagtcagtgaatgtgatcttctgattgtaacaggagcaagattcagtgaccgtgtgacaggaaatgctaagaaatttgccaaggatgcaaaaatcctgcagtttgatgtagatgcagcggagatgaataaaaatatcctgattacagaaggggtagtcggtgatctgaaagtcgttcttcagaagatgaatgaacgcctggaacagcagaatcataaggaatggatagagaagattatttcttataaagagaagtatccaatgacatatcatccggatgtactcagtggtccgttcatagtggaagaaatttaccgtcagacaaatggcgaagcaatcatttctacggaagtcggacagcatcagatgtgggcggcgcaatattataaatatacagaaccaagaacacttcttacatcaggagggcttggaacgatgggatatggtcttggtgcttcacttggagcgaaggtcggaagaccggaaaagacggtagtcaatattgcaggagacggatgtttccgtatgaatatgaatgagattgctaccgcaacacgccataatatcccggtaattcaggtagtgatcaataaccatgtacttggtatggtgcgtcagtggcagaatctgttttacgaacagcgctactcggctactgtactcaatgatgctgtagattttgtaaaacttgcagaagctatgggagcagaaggagtacgtgcatcgaccagggaagaattcaaagaagcatttgcaaaggcattaaagagcggtcacccggtagtgattgattgtcagattgacagtgatgacaaagtatggccgatggttgcccctggtgctccaatcagtgaagcttttgatgagaaagacctgaaaacaaaaaatgcagaataaaagaagcaaaaagtaaagaaaagtggaggaacaacaatgagcagagtgtacaatttttcagcaggtccggccgtattgccggaagaagtattaaaagaagcagcagcagagatgttagattataaaggctgtggaatgtcggttatggaaatgagtcaccgttcatcggtgttccaggagattattgagacagcagaagctgatatccgtgatctgatgcagattccggataattataaggtattattcctgcagggcggcgcatctcagcaatttgccatgattcctatgaatctgatgaaaaataaagtggctgactatatcgtaaccggacaatgggcgaaaaaggcagccaaagaagcagaaaaatacggagaggttcatgtagtcgcatcttccgaagataagacattttcttatattccggactgctctgatcttgaaatctctgaagatgcagattatgtatacatctgcgagaataatacgatttatggtacaaagttcaaagaacttccggatacaaaagggaagacactggtggcagatgtgtcatcctgtttcctgtctgaaccggtagatgtgtcaaaatatggcgtgatctacggaggagttcagaaaaatgtaggacctgcgggtgtggtgatcgcaattatacgtgaagacctgattacagatgatgtattagatggtacaccgaccatgctgaaatataagacacatgcagatgccggatctttatacaatacaccgccggcatatggaatctatatctgcgggaaagtattcaaatggctgaaaaagcagggtggtctggaagcaatcaaagagcgtaatgaaaagaaggcaaagattctctatgattacctggatgaaagtaaattattcaaaggtacagttgttccaaaagaccgttcacttatgaatgttccatttataacaggtaataaagaactggatgcaaaatttgtaaaagaagcgaaagaagccggatttgaaaatctgaaaggacacagaagtgtcggaggtatgcgtgcaagtatctacaatgcgatgccggttgaaggagtggaaaaactcgtggaatttatgaaagcatttgaaaaggagaatctgtaatcatgtataagtatcataatctgaatccaatttcacaggtaggactggatgaatttacaaaagactatgcacctgtaagcacaccggagacggctgatgcgatcctggtaagaagtgcggcaatgcacgaaatggaatttgcagcagatctgaaagcaatcgcaagagccggtgcaggtgtgaataatatcccgcttgagaaatgtgcggaacagggaattgttgtatttaatacaccgggagctaatgcaaatggagtaaaagaattggtgatcgccggtatgctgttggcatccagagatatcattggcggcatcaactgggtgcaggagaatgaagaggatggaaacatagccaaagatgcagaaaaggcgaaaaaagcatttgcgggacaggaattgcagggaaagaaacttggagttatcggtcttggagcaatcggtgtgcttgtggcaaatgctgcaacacatcttggcatggatgtatacggatacgatccatatgtatcggtggattctgcatggagactttccagaagtattcatcatacaacaaatgtagatgaaatctatgaaaactgtgattacattaccgttcacgtgccggcacttgacagcacaaagggaatgatcggaaaagatgccctgagccttatgaaggaaggtgtgatcgttctgaactttgcaagagatgtgctggtggattccgaagcaatggtagatgcacttgttgccggtaaagtaaagcattatgttacagatttcccgacacctgagattgcaggtgtaaagggagcgattgtaattcctcatctcggagcatctacggaagaatctgaagataactgtgcaaagatggcagtgaaagaagtgatggattatctggaaaacggtaatatcagacattcggtgaactatccggattgtgatatggggctgagaggagataagacacgtattcttgtattacatcacaatgtaccgaatatgatcggtcagatttccgctgtccttgcaaaagataatatgaatattgcagaccttacgaataagagcaaggggaaatatgcgtatacaatgatcgatgtagattccgaagtgccggaaggtgttgtggaagaactgaaacagatcggtgaagtgttacgtgtacgtgttatatgttaaataaaacttaataaatttgtaagaatcccttaattgcgaaatatgtcgaattagagtatcctattaatgaaagagatgcagtaaagatatcttcatatctgataaacagaacttatgaaatctgggggatacagggaatggacaatacagggattcgatcaagacgtaagaaatataggagaagagtaagaaacattcgtgtgggtcttactctttttgtcatatgcctgatcgctgtggcaataccggtcatacgtgaaatgctaagaaaaccggcacagattacgatacaggtcgctgatattgaggttacgcagggaacagcacttccgtcgtatacggcagatgtaaagatacaggacaaagataagaacaagcttacaaagacatatactgctgaggactttgcaaaagatctgcaaaaaggaaaagatattaccatttctagtaaagctgattcgaatatagaaggaacttatgtgattacagcaaaactgtcagagaagattaaaaaagaactgaatggagcatggaagaaaaaggcgcaggtaacaatcaggaacggaacctgtaccgtgaagaatccaatcggtgtatggaatggtaataaatttaaaaaatacgatggaacttatgtaacatcagatttcgtggtgtcgaagggaaatacatattattttgatgcagatggaaataaagtgaccggctggcagaccattgagaatgcgttatattgttttgatgaaaaaggaatcatgcagaagtccgaatggattacaacggatgacggaagagcatatctgagtgatgacggcaaggcactgagcggctggcagaccattgacggaaaagagtattattttgattcaaaaggaattgcggcaacaggagagctgaagctcggacttgagaaatgtaaattcagcgagtcgggagaattgctctcgaaagaaaaaacagagatagatccgggaaaaccgatggtggcacttacatttgatgatggacccggaccaagaacatcagagattctggatcagttgaaaaaatataatgcacatgctacattttttatgctcggaaaaaatgtaaaatcctatccggatgccataaagcagatgttgaaagatgggaatgaacttggaaaccattcctatgatcaccagcaactgacgaagattgatgcagaagcaattgccaaagagatcaatgatacgaatgaaaatataaagaatatctgtggaagtccggctactgtattaaggcctccgtatggtgcaattaatgatacagtgaaatcaagcgtaggtatgccgatgattctctggaatgtggatacactggactggaagacgagaaatacacagagcacaattgacgaggttatgcgtaatttgaaagacggagatatcatactgatgcatgatattcacacacagacagtagatgcggcacttcagctgattccaaaactggaagaagagggctatcagctcgtaaccgtttcggaaatggcagcggcaaaaaacaagacgttggaaaacggaactgcttacagtgattttataagtacaagtaaaaaataattagatatatctattataaaacaggatcaaccggtaaaagttgatcctgtttttaggttcgtttataacgaagtattatgttttgctaacagacggtgaatcttttctgtaggatccataacctttccgatgctgatatcatggttcatagaatcgatgatcagtgcgataaacttactcatatctgcgatcaggaaataaggcttttcctttgcttcggcaggaagataagtgagattagtagtgatcacgcggtcgatgtaacctttttcataataatcatcaaatttttcaaaaccatcggtaaagagtccgaatgtggtgcagacaaatacccggtttgctccgcgggctttaatctgttttgcaacatccagcatactttcaccggaagaaatcatgtcgtcaatgatgatcgcatcttttccatccagatgttcacctaagaattcatgtgcaacaatcggattctttccgtttacaatagttgaatagtcacggcgtttgtagaacatacccatattaacacccataacgttagaaaagtatacagcacgctgcatagctccctcatccgggctgatgatcatcagatgttccttgtcaactttaagatccggctccgcttttaataatgctttcataaattgatacggtgggttaaagctgtcaaatccgtggagaggaatggaattctgtacacgtggatcgtgggcatcaaatgtaaatatattagacacacccatatcgatcagttcctgaagtgcaagggcactgtctaaagattcacgtttggtacgtttgtgctgacggctttcatagaggaaaggcattaacacattgacacggtgtgcttttccgttggcggcagcaatgattctttttaagtcctggaaatgatcatccggtgacatatgattcagatggccgtttacagaataagtaaggctgtggttgcagacatctaccataaggaacagatctgttccacggatagattctgtaagaagtccttttgcttcgccgcttccaaaacgtggacacggacaatcgatcagataattgtcacgcaagtaattataatataatggtgaatctgtgttcttgtccagtgtgctttttctgaactgtacaatgtaatcatttactttttcaccaagttcgcggcatgattccagagcaccgatttttaatggtgcaacaggaagcacgctttccattaatttgatatttggcataataaaaactcctgtgtattttatatattaagttactcctaattatttatatcactttttctataaaaaggtcaactactgattggactatttgacaaaggtaatgtataatagtatcgttaagagacaaatatagaatgaaatatagaggagagttaagatgagtaaaccagtagttgctattgtgggaagaccgaacgtaggaaagtcaaccctttttaatgtactggcgggagagatgatttcaatcgtcaaagatatgcccggagtaacaagagaccgtatctatgcagatgtcacatggctggacaaagaatttactatgatcgataccggtggtattgagccggagagcaaagatatcattcttgcacagatgagagaacaggcacagattgctattgatactgcagatgtgatcattttcattacggatgtcagacagggacttgtagatgccgattcaaaagttgcggatatgctccgcagatcaggcaaaccagtcgttctggcggtgaataaagtagacagttttgagaagtttatgccggatgtatacgaattctataatctggggattggtgatcctgtgccggtatcggcagcttccagacttggtatcggtgacatgttagatgctgtgatcgcacatttcccggaacatgaagctgaagagaaagaggacgagcgtccgagagtggcgattgtagggaaaccaaatgtaggaaaatcttcaatcatcaacaaactgaccggaaagcagcgtgtgatcgtatcagatatagcaggaacaactagagatgctattgataccaatgtgaaatataatggaaaagattatgtgtttattgatactgcagggctgagacgaaagagcaagataaaagaagaactggagcgctacagtatcatccgtacggtaactgcagtggaacgggcagatgtcgttctggtagtaatcgatgcgacggaaggtgtaacggaacaggatgcgaagattgccggtatcgcacatgaaagagggaaaggtatcattattgttgtaaataaatgggatgccattgaaaagaatgacaagactatgaaagagtacgagaataatgtacgccgtgtgctttcttttatgccgtatgcagagatcatgtatgtatcggcagagacgggacagcgcctgaacaagctatatgatatgatcgatatggtcattgagaaccagacactgcgtgtcgcaacaggtgttctgaatgagatcatgacagaagctgttgcaatgcagcagccaccttcagacaaaggaaagagactcaaactgtattacattacacaggtagcggtaaaaccgccatcattcgtgatttttgtaaataataaagaactgatgcatttttcttataccagatatctggagaataagatccgggaggcatttggattccgtggtacagctttgaaattctttatcagggaaagaaaggaaaaggatcagtaatcatggaacggttgatatgtgtacttgtcggatatgtgtttggtctgatacagaccggatacatatatggaaaaaagaatggcgttgaccttagaaaaaaggggagcgggaatgcaggaacaacgaatgcacttcgtactatgggctggaaagcaggagcggtcacactgcttggagactgctttaaatgcgtagcggcagtggttgtcgtacatctgatctatggaaagacacatacagatatgatgcctttactttccatgtatgccggaatgggagcagtcctcggacataattatccattctatctgaaattcaaaggcggaaaaggtatagcagcgacagcaggtctgatcatcagtactacgaatatatggatcgtactgatctgtcttgcagcatttattgcaattgttgcggcaaccagatatgtatcccttggttccatgacggttgttacaatctatctgatcagtgtgatcgtatatggtcagcacggtggatttggtgtggagaatgtatcctatctgcatgagatgtatggtgtagcagcgtttctaatgatactggcattctggagacacagagcgaatattaagagacttttaagcggcacagagaataagatcagtgttggcggaaaggataaaaaatagtcaggaatgacagataaaaagaaaggacaggctatggcaaacgtaagtgtgatcggagccggaagctggggaacagcactggcattactattatgtaaaaatggacatgatgtgacggtatggtcatataaggaagaagaagtgcgcatgctgagtgagaaaagagaacatttaagcaagcttccgggagtaaagattccagacgaaatattttttactgcggatttgaaagaggcagtagaagaaaaggatgtagttgtacttgcagtaccgtctattcatgtgagaaatactgcgaaaaagatgaacgcatatataaaaggcggacagattttagtggatgtagcaaaaggaatagaagaagacaccctgatgacactgtctcagcagatcgaagaggagataccgcaggcagatgtggcggttctttcaggaccaagtcatgccgaagaagtaggaagaggtcttcctacaacggtctgtatcggagcacatacagagacaactgcaaagtatttacagcagctttttatgaatgaagtgttccgcgtatatatcagtccggatattctgggaattgaacttggcggatcgcttaagaatgttattgcacttgcagccggggttgcagacggaatgggatatggagataataccaaggctgcattgatcacccgtggaattgccgagatatcaagacttggtgtaaagatgggaggagcggctgagacttttggtggtctggccggtatcggagatcttattgtaacctgtgcaagtgtacacagccgtaaccgcaaggccggatatctgatgggacagggcagaacgatgcaggaagctatggatgaagttaagatggtagtggaaggtgtatattctgcaaaggcagcagcgaagcttggaaagaaatatcaggtatcacttccgattattgaagaagtaaataaggtgctgtttgaggacaaaagtccgaaagaagcggtaaatgaactgatgctgcgtgttggaaaagcggaacatatggctcttccatgggaataataaaaagagtcagttttgcaatatgatataaaaataacagagaggaaagattgttaaaaatctttcctctctgttattttttaaagatccgcatgttctattacatactttttgaaatccatgatgacaggtgcctgatagacattttttaaagtagccatataaaagagtctttcccacgaaggtttttctatttcgataatagataccggcatataagaaagaatgggcatctttggaacaactgcaataccaaaacctgcaccgacaagacctgcaacgccctgatcttcttccatggagtaagcaatctgcgggtaacctccacatttatgaaacaatttgtcaataacatatcttaagccgcttcgtttggaaaaagcaatatgcggataagaaagtgtatctttcagatcaatagagctgcgttcttcaagcggatgtccttttggcacgatcaataccagttcctgttttgcaacaggtatgaattcgatcagaggttcattgtccatcatagagcaaaatgcaatgtcatatttccggtcttttaacccctggatcatatcagaagtaagacctgtagaactatgaaaatagaagtcaatctttttgtccggcgtagaatccaggaatccttttacgaaaccgggaaccacagtactgcttagagtgcgcagttccacgatgtcgatacgaccttcaccacgacctgtcatctgaagcttgttaacactggaatcgatcatatccagagcctgttccacatcaatgagaaaggcctgcccgcattttgtaaggactacattccggccctctttctcaaaaagttttacccccagttctttttcaagagatgcgatcgcatgactcaggcttggctgagtgatggaaagaatttcagcggcttttgtgtaatgctccagatgtgccaacgtggcaaaatatcttagatgatacagattcataaagccggtccccctttcttttgttatatttatatatgtttatatcttatcatgaacggagtggaaaaactatgaataaaatctataaattataatagaataaccaatttgttttttatttaacaaggatatataatcaaaccatagcaaatattactagattgaacattaagcaaaaagggaatctgttcaattttaacaatggaggtagaattatgtcaaaaaagaatccaattacagtaagttcatggacacttggagatcagtgcaaatttgaagaccgtgtgatcgctgcaaaagaagcagggtatgaaggaatcggtcttcgtgcagaaacttatgttgatgctttgaatgagggacttcatgacaaagacattcttgcaattcttgataaacatgacatgaaagtaacagaagttgagtatatcgttcagtggtgcgaagagcatcgttcatacgagcagaaatacaaagagcagatgtgcttccatatgtgtgaacttttcggagttggtcatatcaactgtggactgatggaaaattattccgtagaatatacagcgcagaaattaaaagagctgtgtcagagagccggaaaatacattattggtgttgagccaatgccatacagcggtattccaaaccttcagaaaggctgggaagttgtaaaagcatccggatgtgagaatgcaatgcttatccttgatacatggcactgggtaagagctgatcagccatatgatattcttacaccggagattgctgaaaaagttatttccatccagatcaatgatgcctatgagagaccatatgcagattcaatcttaagagatgagtccatgcatgaccgtcttgcacctggaacaggagcaaaagatacagctggattcgttaagatgatcaaagatgcaggaattgatccaaaggttgttggtgtagaagtaatttctgacgagatccttggaagaggaattaacgaagcagcagcttatacatatgagaatactgaaaaagtattaaaagaagcttggccagaactggtagactaatttatagaaatcagatttgttcaaaagagagagggaaaaaataatgaagttcaaaaatatgttttctccgattcagatcggaccaatgacagtaaagaaccgctttgtagtaccaccaatgggaaataattttgcaaacacagatggaacatggagcgatgagtctgttgcatactatgctgaacgtgcaaaaggtcagtttggcctgatcacgatcgaagcaacagttgtccataaaggagcaaagggcggcccgagaaaaccttgtctgtatgatgacaacagcattgagagtctgaaaaagattaccgatgcctgtcatgcagaaggtgctaagatttccattcagcttcagaatgccggaccggaaggaaatgccaagaatgcgggagcaccaatccaggcagcaacagctattgcagcggctgatggaagagacattccggaagcagttcctacagagcaggtatatgagcttattaaaggatatggagatgcagcagtccgcgcaatgaagggcggagcagatgcagtggaaattcacatggcacacggttatcttgtgaattcttttatgtcaccaagaacgaataaacgtgtagatgaatttggtggaaatttcgaaaacagaatgagattttctcgtctgatcgttgaagaagttaagaagagaacagaaggtaaaattgcagtgcttgcacgtatcaacagtacggaagatatgtttggcggtctggataaccatgatatgtgtgcaattgcttcttatcttgaagattgcggagtagatggacttcatgtatcacgtgcggtacatctgaaagatgagtatatgtgggctccgacaggaattcatggcggattctcggcagagcttgtagcaaatatcaaaaattgtgtatctgttccggttattacagtcggacgttacacagagccacagttcgcagaacagatggtaaaacttggaaaagctgatctggtagcgtttggacgccagtcactggcagatcctcatactcctgaaaaagcgcaggaagagagactggaagatatgacaccttgtatcgcatgtctgcagggatgtgtcgctaacatgtatgccggaaaacctttgtgttgtctggtaaaccctgtgcttggccgtgaggcagaaggacttccgaaagcagaaaaggcaaagaaagtatatgtcatcggtggcggagtagcaggtatgtgtgccgcattcacagctaagagacgcggacatgacgtgacattatttgaagctacagataaacttggtggaaacatgagacttgcagcttatccgccgggaaaaggtgacatcacaggtatgatcagaagctatatcgtaaaatgcgaaaaagccggtgtaaatatcaagatgaacacaaaagtaacagcacagatgttaaaagaagatacaccggatgcagttatccttgcaaccggatctgagacattagtccttccgtttatcaaaggtatccacaaccctgatatcgtatatggtgtggattgtctggaaggaacacgtccggtaggacataaagtcttagttgtaggcggcggtatggtaggtgccgagacagcagatttccttgctgaacagggacatgaagtatctgttatcgagatgagagatgccattggaccggatgtgatccacgagcaccgtatcttccttatggaagcatttgaaaaatacggaattgaacagattacaagtgccgcagtatctgaaatcttctcagacggcgtaagctataagaatgccgcagataaatctgatgagacaatttacgaggcaagaggattcgacacagttgttctttctatgggattcagctcccgttatacacaccgcgatggtcagaatgttgtatatgacttcgccgatgaattaaaggacattgttccggaagttcatgtagtaggtgatgcagtaagagcacgtcgtgcattggatgctacaaaagaagcttacgatgtggcattaaaactttaataattgaatttagaaatgataagaatgtgtatgtgacagcccgcagcatacgggctgttatgaaaataagagaaaaccaggagggttaagatcatggaaaaaagaatttccggacatacaggcttaatggcgttatttggaacaccggtcggacattcaggatctcctgcaatgtacaacttcagcttccagcatgatggattggattatgcgtatatggcatttgatgtaacagaagaggaaatgccgaaagtattcgagtctatccgtttattaaatatgcgtggtggtaactttactatgccatgcaagaacatcgctgcacagctggtggacaaactatcacctgcagctgagatcatcggagcctgcaatgtattcgttaacgatgatggagtaatcacaggacacattacagatggtgtcggattcgttaagaatctggaactcaacggagcacctgtaaaagacaaaaaggttgttgtccttggagcaggcggagctgctacagcaattcaggttcagttagcactggatggagcaaaagaagtaaatatcttcaatatcaaagataaattctttgaaagagcagaaggaacaaaagctaaattagcagagaagtgtccggagtgtgtagttaccgtagatgaccttgatgacaaggctaaactggaagatgcaatcaaagcatgtgacattcttgtaaatgctacaatcatgggaatgaaaccacatcaggatgtgacactggttgacaaatcgttattccgtaaagatctggttgttgcagatactgtatacagcccggaaaaaacaaaaatgatcctggaagcagaagaagcaggatgcaaggcaatcggcggagtgggaatgcttcagcagcagggagcagtaaactatggactgttcgttggaaaagagatgcctcttgccgagtatcaggaattccagaaagcacaggcaaaataaaagacaaaggagaatgagggaatgaaagcaaagaaatatttatggtctatcatctgcgtatatttttgctatctgacacatggaattcaggcaattatattaagccagaataatgtgaatttcgcaaaacagtggggattcaatatgtcagatccgcagtctgcagcatatgcagcaggacttgcagcagtaagtacagcagttgcatggactggatttggtaaattcgtaagcgtatggattggtggagaaatctctgaccgtgtcggacgtaagaaactgatgatcggtggagcagcattatatattatctgcttccttggattcttatttactaagagtgcactggttgcttctgtatgcggttttgcatctggagttgcaacttcaggattctgggatgcttcaggataccctgcagtacaggaagcttatccggcagcacctggatcagcgcttgtaggaatcaaattcttcgtttcactgtcaggtatggtatatccacttctggtagtacataatgcaaacagtggaaactggaaattaaatgttatgattccggtagttatgtctattatctgtttagtacttgcaattattgcgccattcgtatatgatgatcagaagaaggcagcggaaggaaatgatggaaaatcaaaagatgcagtacaggcagaaattgatgcagcgaaagcagctatgcttacaaaaccgagcaaatttgtagtatttctggtaatgttttatgcattcctctgtatggcaatcatgtatggtgctcagcagtatacgaaagcgttcggattatctgtatgtggattgtctgagatgcaggcagcaggtatgacatctatctatacaatcggttctatctgtgcagtacttttctgggcattcatgatggctaagttaaaatggagcccgctgaaagttgtcctgattgattctatctgtacagcagcagctcttgcaggtgtgctgtttattcatcaggtggcaatcatctatgttgcaattgcaatgttaggattttttgcggcaggtggtgcccttcagaccggacttgcagtggttcagctgtttaacccgggaccaaagggaagaaacaccggtatctattacacatttatgggtgcagcaagctacctgattccggtagtggcagcacagcttacaaaagcatcgggtgaggcaaatgcagtatatagcctcatgatcatgttattggtatttgcaattcttgctattttaagttccctctacttagtagcgcagcacaagaaaatcttcggaaagagtgcattgtaaaaaatgtaatgaaggacaaaaagggactgttgttccggatggcagcggatagacagtcccttccttttaacataggattgttaaaaaaaagacattcatagaaaatactaaaaaattagaggataatacatgtcattctatagaaaacatctatggaatgatcggtgttatatcataatagctagctgatgctgaagcatacgaagaatatttgtatgaaaaaatcataagacgaaggaggacactcaaagatgagtccgaaaagagcaaaaagagccaatgaacttccctttattcctcttggtccatttcaatggagaattccgggaatccattacagagtagaatatgtggaattttttcagggtctgatccttggcgcaacagctttaagttctattccgtatctgacagataatcttggacttccatatgaacttgcatggagctgtgtcatcattgaagtatttatgtatatgcttcatggatggttaggggatccggtagttccgggatggattactccgacactgccatttaccctggcgtatttaaatgggttcgaaaagggaccagacagaatacaggcaatgatcgcgttgcagcttctggtcgcatttgtatttatatttatgggaattacgaaactggcagacaaatttgtaaatggtgtgccaaattcaattaaaggtggtatcttgatcgctgcaccgattacggtattgcagggacaattatcggatggaagccagcttatgactgcaccggtagcaacactcgccggtacattattgctcgcatttttaagcttttcaccattctgcgaaaagaacagaagtaaatataaaatattagatatcatggcaaaatacggcaatttgttcccgtatctgattgctatggtagcaggggttgctcttggagagttatcaaaacctgtattagaacttggaacagtcatcagaattcctgatttcagtaatatattccatacagtcagtatctttgcggtaggtttccctccgctttcaaagttcatcagtgccatacctctggccttgatctgctatgtactggcatttggagattttgttacatcaaagactctggtagaggaagcacaggagagcagaagcgatgaatatattgactttaactcgagcagatcaaatctgatcagtggactgagaaacctgatccttgcgattttcgcaccattcccgccactggcaggaccgctttgggttggaatgaccgtatcggtagcaatgcgctataaagaaggaaagaaagcaatgaaatcattgatcggtggaatgagttctttccgtatggcgacatttatcagtgttattctggtaccgatcgtatctttcatgaaaccaatcatgggagtcggatcggcaatcacattattgttccaggcttatgtctgtgccagaataggtatggaatactgtcagtctaacacagataagagtattgcaggtgttatggcagcggtattggcattcaaaggatccggatgggcattgcttgtcggttttgcaatgaacctgttactttcaaatatggatttccaaaagaaaaaactgggagcgcttacaacggaagaactggatcaggtagaagcgaaaagaaacgaagaagtgcagaggcttcttgcccagaaaaatcaggaataaaaataataaaataaacataaaatgagggcctttgggaatatccatgggccctctctctgcttaaatttttttacagtgcatcgtgcacaatctgaagtgcctgatgtaatgcttctgctccaatctgtccgggtgcagaagcctgtgcgccggaaccaaatgtcagacaggatccaaatatctcacaggcaatacggctgatacttccaagccccgccatggacatcgtgataatcggcctgtcggcatagtcggatgccatctcttcagttgcggaaagaagagtcaggacatcttttttcgtctgcggcataacagccatcttaggaatatcggctcccatatcctgcattttgcgaagacggtaaagaagatcagatttggcaggcgttttgtcaaaatcatggttagaggcaatgacttttgtgccggaagcatgaatcgcatcgatcatttcccttacaatatcatcacccgtaaagatctctacgtcaacgatatccgcattgccggtggcggcaacggctttgttgagcctggcgtatttttctgtagacattggatgtacgccgccctctttgtctgtacggaatgtacagagaagaggagtatcacccattacattacgaagttcttttacgagttctgtgacttttgcaatatcttcgacatcttcataccagtccatacgccattccatcagatccatatgcatatcaagatatgtacgggtaagggaaaggatgtcctcttttgtcttaccgacattaggaatgcagattgccggaattccgtttccaagttccagatttcttacttttacagtgttcatagaaaacttctccttaatcttcataaacgtaggaaattcccagtttttctttcatatattcgctgtccacacgtttgccgagaatcagttcgatagcggcaattgcctggaagagcatcatgccctgaccattcattgttttacatcctgcatgtcgtgccattttgagcattgttgtttcgtgtggtgcgtagacaacatccgttacgataagatcagggcggaagaaagaaggatcaggaatataggtaattccttcgagcggtttcattccaacacctgtggcatttgtgaaaagataagatgaatgcatctcttcttttaatttgtccagatcttccagtgggtagaatgttgctttacaattggtgttttcgttgattttctttaccgtatcgagtgcattctgtttgaatttgtcatctcttgcgaagatagacatctcagcaacaccatccagtgcagcctggatctcaacagcagtagcagctccgccggaacctacaatggttactttctttccggtagggtcaatgtcattgtcctttaaagactgtacataaccgataccgtctgtgatgtgtccgaccaggtagccgtctttattgacgatggtatttactgcaccacagagtttggcagccggagagatttcatccagatactgatgtacgattgtcttatttggcatagaaacattggcaccacggagcttcagtgcgcgtaagcccttgattgcatcttcgagttcaggtgcatctacttcaaatgcgagatttacgatatcaacacccagcttttcgtaagctgcattatgtgttgcaggtgactgcgagtggcggattggataagccagaagaccgattaattcggtgtgtccggtaatctgatgtctttccataataataatctcctttttgtaataaaactttatctttgcttatattttaacaaattacagatgcataaacaaatgctaaacagatacggaaatgatagaaaatgactattgatctgcagtgcaagttctataaagagcgaagaagtgcatatactttaacagcacaacgggaaggagcagggaaagtggacacagaacagttatataaagatataaaagcaagaacgcacggagaaatctatatcggtgttgtaggaccggtaagaacggggaaatcgacatttattaagcgttttatggatgtaatggtattgccgagaatggaagatgaacatatgaaagagcagacaagagacgaacttccgcagtctgccgcaggcaaaacgattatgacaacagaaccaaaatttgtaccgaaagatgcggcagtaatacatctgaaccgggacgttgaagtgaaggtccgtctgatagactgtgtcggatatttggtaaagggtgcttcgggatacgaggaggccgggcatgaacgtatggtaaaaaccccgtggtaccaggaagaaataccatttaccaaagcggcagtgacaggtacccagaaagtgatacgtgagcatgcaacgataggaatcgtggtcacaacagacggaacgatcacagatatcccgtcagataattatgaagatgcggaggcacgtacgataagggaacttcagtcgatccggaaaccgttcgtggtattggtaaattcaaaaaaaccgcatggacaggaagctaaagaaaaggtcaaaaagctggaagatacctatcagatcagagcaatgactgtaaattgtgaacagataaaagaagaagatatttaccagattttggaggccgttttgtatgaatttccggtatcggaggtacagttttatataccgaaatgggtggaaatgctttcggttacgcataagatcaaacaggatctgctggaacatatacaagaaattcttggaaatcttgaagaaattaaggatgcggtatctttgaccgggaggccggacagttcttacataaaagactggtatgtagaacagatacagatggatacaggctgtgttatcattcggatccatatgtatgaaaagtattattatgaaatgttgagcgagatgacgggaactacaatttcaggtcagtatgacctgataaagacgatgaagaagctttcaatgttaaagaatgaatatgaaaatgtagaagatgcatttacagcagtccggatgaaagggtatggagtagtcagtccgacaaaagaagagattattctggatgaaccggagatcatcagacagggaaataaatatggggtgaaaattcattcgcaggcgccttccattcatttgatccgtgcaaatatagagacggagatagccccgattgttggaaatgagcagcaggcggaagatttgatccagtatattaaaaatgaagaaaaaatggaaggaggtatctggaaaaccagtatattcggaaaaacagtggaagaactggttatggacggcctgaaaaataagatggcggtcatcaatgaagaaagccaggaaaaacttcaggatagtatgcagaaaatcgtaaatgacagtaatggaggcatggtatgcattatcatttagaaaaaaagtaaataaatatgaaaaaatacttgaaatctgtgaatgaccgtgtctataatatgaattagaaattggtaaaggggccatactcgtcagggtgtggtctctttttttaccataatagataataagaatctggaggatgataaaaatgaaagattacacgttcaaagtaccgcaggatattgtatttggtgtaggttctttaaaaagactgccggagcttcttgaaaaaagcggttctaaaaagatgatggtagtatcagacagagggctggagaaattaggagtcgtacagaaagtgctggatattgtggagacagaaggtatagaaacagtaagttttcttgatattcttccaaaccctacagtggatatggtaaatgcggcgacaaaggtatataaggaatcaggagcgacaagtatcgtagcacttggaggcggaagcccgatggatgttgccaaggcggtaggtgttctggcaagatacggcggatccattacagagtatgaaggtgcacatcttgttccgggaccgatcgaaccaatcattgcaattccgacaacagccggtacgggaagtgaagtgacggcattctccgttattacagatacctccagaaattataaactgacagtattcagttacgaattacttccaaaatatgcattgttagatccggagatgatcatgtctgtaccaccgatggttgcggcttcatgtggaattgatgcactgatccatgcatgggaagcatatacatcacttggcgcttcaccgttttctgatgcaatggcagaaaaagcaatggaactgatcggtggtaatatccgtagatttgtggcaaacagaaaggacgaggaagctgcatgtgcaatgatgtcaggaagtatgtttgccggaattgcatttgcatgggcaagactgggagatgtacatgctatgtcacatccggtcagcgcattctttggtgtacagcatggagtggcgaactctattctgcttcctgtgatcgtagagtataatgcgctggcagatcacggacgctatgaaaaaatctacaattatatcagtgaagataaagagccggtaaaagatttcaaaccagagatgctggtggcagagatcaagaaattaaatgcatctcttggtattccaaagactctttctgaggtcggtgtaacagaagacaagattccgcagatggctgtagatgcgatgaagagtggaaatattgcggctaatccaagacagacaacattaaaggatgtggagatgttgtaccgcaaagcactgtaaataaaatagcgaaaaaagataatagaaaaagattcacattttgatcaatattttagaaaatggaaaatgtgaatctttttttgtgggaacatgcggaaagccgtggaataagttttttggcatccgtaagtgtcggaaataaagcttataagattgcattatcatgacaaaagagttaaaatatagaggtatatgactatcacagataaatgttggaggtacaatatgaaagtagcaattattacagcaaatacagatatatacaaagggacaaaagcgaatgaaagcggagaggcagtaaagcttgtagcggaagaagccggactggaagttgtatttatgagagcactgccgctggacagagaagtattgtccgcaattatgaaacgtttggcagatggaaaagcagcagacctgatccttaccacaggtggagcagggtgcaatccggacgattgtacaccggaagcaacgatggatattgtagaaagaccggttccgggaatcccggaagcaatgcgggcacatacaatgaagctcaccagacgcagtatgctgaatagaagtgcggcaggaatctgtggagagactctgattgttaatcttccgggaaaagcacaggcagtgaaggagagtttaagatatttacttccggagctcgtacatgctgttaaggtcatcaaaggagaagtataggagatatgaaggttacatacctggagcatagtggatttgcagcagaatataaggaatatgtgctgatttttgactggtacaggggcagccttccggaatttgatcagcagaaaaagatttatgtatttgccagtcactcgcattatgatcattttaataaaaaaatcttcggatggagtgagcaatatccagatgttcggtacatcctttcagcagatattgcaggaaaagaacagtcagaggaacagtcagagcggactgtatatgtaactgcaaataagaaatatgattttgatggtataaaggtacagacacttcattctaccgatgagggggttgcatttattgtgtatatggaagacaaggtaatctatcatgcgggggatctgaactggtggcactgggaagaagaaacagaaagctataatgaacagatgcgtcaggattatcagagggagattgacaagctgaaagatattgtaattgatatagcgtttgttccgctggatcccagacaggaaaatcagtatgcgtggggaatggattattttatgaaacatacccatacaaaatatgtgtttccgatgcatatgtggggagattacgaagtttatgaccgtctgatggagaaccctgaggcagagccatacaaagaacgtgtaatagaggtaaaagaaccggggcaggtatttgaagtgaatgtgtaatgcaaagaatcagaataaaaaagatttgttattttaataaaatagtgttataataataaacgcttttgaaaaaatgcaagtaagacagatgatcgcagctgtaattgccgaaaggcagcaggtgaggaaagtccgggcttcacagggcaggatgccggataacgtccggtggaggtgactccaaggatagtgcaacagaaatgtaccgccaggatctgatcctggtaaggttggaagggcagtgtaagagactaccgccttgctggtaacagcaggggcatatgtaaaccccatccgaagcaagaccggataaagacgatgtggcggcccgtcacgtcttaggtaggtcgcttgaacccgctggcaacggcgggtctagatagatgatcatccaatgacataacccggcttatcgtcttgcttgtataaaaaagagaacttgtcagctgacaggttctcttttttgtcccaaagaaattatttacgtcttccgtcgtatttttcttcacagtatttacagcggtagacttccttttcaggatcggtaagtacaaatatatgatccagtccctgttcgatcgaggtgatgcagcgcgggtttttgcagtggatcacattgcggatctcgtgaggcagatgaagcgctttcttatctacaatcgcggaattcttaataatatttacggtgatgttatgatcaataaaaccgagaatgtccagatccataaagtcgatagggcattcaatcttcatgatatctttctttcccattttattactttttgcatttttaatgatcgcaacacagcagtccagtttgtccagatgcagatatttatagatatccatgcttcgccctgcctgaatatgatccagaacaaatccttcttcgatacgaccgacagttaatgtattttttaccattgttattatcctcctaaacttcaatttccaaaagtgtaagtatcagtgccatacggatgtaaacaccatattgtacctgcttgaagtaagcagctctcggatcattatctacctctgtggcaatttcatttactcttggaagcggatggagaatatacatatcttcttttgccagttccatctttttgttatccaggatgtagaagtctttcatgcgtacataatcttcttcgttaaagaaacgttctttctgaacacgggtcatgtaaagaatgtccagatcaggaagggcatcttccagccgtacaacctcttcgtaaggaatgttctgacgatctaacacatcatttttgatatagcttggaagttttaattcttctggtgagatcagaacaaaacgaatacccggataacgtaccagcgcatgaatcagagagtgtacggtacggccgaatttcagatctccgcataatccgatcgtcatattgtcaagacggccttttaaagaacggatcgtgagcatatcagtaagggtctgtgtcggatgctgatgtcctccgtcccctgcattgatcaccggaatcgtggcgtgctggcttgcaaccatagcagcgccttcttttgggtggcgcattgcacagatatctgcgaagcaggaaattacacggattgtatctgctacactttcccctttagaagcagaacttgaatcggcagatgagaaaccaagaacgctgccgccaagattgatcatggctgcttcgtggcttaatctggtacgtgtacttggttcgtagaaaagagtggcaagttttttgccctcgcatgcatgtgcatatttttttggattggcttcaatgtctttcgcaatatccatcaggttgtccagttcttccacggaaaaatctagtggacttaataagtgtttcatgtaaaaacctcctgttttataaataagttaataaatcacttacggattttctcttaggtgtgtccggatcgatatccggatgtccgatcgcgatgagagcggcaagttcctggtcttccggaatctgcagcagatctgtgataccgtcttcatcccagattcccataataacagttccgagaccggcatcatgtgcggcgagacaaaatgtctggcaggcggcgcctacatcgaacatttgccagcggtcttcttttttggtactgtaagaaccgtcacgttcaaagccgcaacggccttttttgaaagtaactgctatcagcatcggtgcctgctttataatttttgcattgaaatctggggtataatcggtaacgattttatcaagaacagaagaatcttcaattgctgtataacgtgtgatctgggtgtttttccaagatggagaataagatgccgcctcgatcacagattctaatgtggcatgatttacaggatcaggtttgaatttgcgaatactgcgtcttgttttcatacattcaattgtattcatggttttacctccgttttcaaatctttcatacatcatataatatttaacatggattttcaatgtcttgaaataatttttaaagaaatttaatctatgtaattttttgaaatgctatgatacggatgggtagattttatggaaagaatgtattataatttaatagatttgcagattttctgcataatatacataaaggagagagtatatggcatcattggaagagcttagggcacagcttggcggtgtagatgacaagatcgtagaactttacgaagagcggatgaaactctgtgaagagatcggaatctgtaagattgaaaatggctataagacttttgaccgtcagcgtgaaaaaaatactataacagacgtgatgaacaaggtatcatccgatattaataaaaagggcatcggggaagtgtatgagcagcttcttgcaatcagcagaaagctgcagtataagcagctggttgaggctggagcacttggaagactgccgtttataggaattgatcttttggataaagatacagctagagttgtctttcaggggacggaaggtgcttacagtcaggctgctatggagcattatttcggaaaagactgtaataattatcatgtacatacgttccgggaagcaatggaagcaatcgaagaaggtgcagccgactatgcggtgcttccgattgaaaattcgacagcaggtgcagtcaatgagatttatgatctgctggtagaatttgaaaattatattgtcggagagacgatcattccgattaaaaatacgctgtccggattaccggggacagacatttcagagattgaacgagtatattccaaggcagaagcattgatgcaggcatcacattttctgggagatcatggtgactggcagcagatcagtgtggcaaataccgcactggcggcaaagaagatcctggaagatcaagataagcgtcatgcggcagtgtgcagtgcatatgcggcatctgtgtatggtctgtccgtgcttgcagataatatcaatgatgaaaagaacaattctactagatttatcgtgatcaccaatcagaaagtattcctgaaggatgcaacaaagatcagtatctgcctggaacttccacatgaaagtagttctctttatcatctgctgtcgcattttgcatacaatgatctgaatatgactaagattgaatcaagaccaatggaaggaaaaagctgggaataccgcttctttattgattttgaggggaatcttgcagatccggcagtaaagaatgcgatccgtggtttgcgtgaggaaagcagaaacttgagaattcttggaaattattaaaagaaaaaacacaacgtcgaagtcatcaggcagaggcagaatggatatatattggaggaaagacgatgagaacaaatgaactgatgttatataaacatatggagaacggacagattctgcaggatatcacattcttgatcgagaattatcagaatgactattataatatggaagatatgaaaggactgttatatgatgcagtcaacgagatcctggagatggcagtcagccatggattcgagggtgatctctggcataattatctgacttacctgatggcaagccatgagaatgcttacagtacatcctgcgaaattgtcggatcggtagatggaagcatcaatcaggttgcactgcacgatttcgaaatattcaaagaattatttgattatgacttcacagatatggaaagtgtgatgggcgttgactgtatttccatgctgcatgattatgtaggaacaagcggacacggaagtgtattcaaccaaagaatccgggatcgtatctgcgatctgagcaaatcacttgcaaaagcagagacggcagaagaatttaaagctgttataacacagttttacaaggaattcggtgtcggaaaacttggacttcacaaagcatttcgtattgcgcacacagaagagggtgcattgatcgaaccgatcacaaagattgcgcacgtacatctggatgatctggtaggatacgagatcgccaagaaaaaactgatcgataatacaaaagcatttgttgagggaaagaaagcaaataactgtctgctgttcggtgatgcgggaacaggaaaatcttcttctatcaaagcaatcctgaaccagtactatgaccagggactgcgtatgatcgaagtatacaaacatcagttccaggatctgaatgatgtgatcgcacagattaagaatcgcaattacaaatttatcatttacatggatgatctttcttttgaagaattcgagattgaatataaatatctgaaagctgtgatcgaaggcggacttgaaaagaagcctgataatgtattgatctatgcaacttcaaacagaagacatctgatccgcgagacattcaaagataaagaagacagagatgaagaacttcatacaaatgataccgttcaggaaaaactgtctctggtggcaagattcggtgttactatatactttggaaagccggataagaaacagttccaggagattgtgcgtgaactggcaaagaaaaacggaattgacatgtcagacgatgaattattcctggaagcaaataaatgggaattaagtcacggtggattatccggaagaactgcccagcagtttatcgattatctggccggaaccagataaaatgtaatgtattgtaaaaaatgtgcagaaattaatcctgcacattttttatatttgaaatatcggagtcaatgaccagagaatagtttgtatagtaaacaacgaatcccggctttgccccgttcggcttcttgacatgttttttctggatatagtcgatctccactttgtctgctccacggtttttagagtagtaagcagccagacgacctgcttcttcaaaggtacggtccggaagttcatccccgccgcttttgacgataacgtgagatcccggagcaccctttgcatggaaccaccagtcattgccattggcaaaagaaaaagtaagttcttcattttgcaggttgttctttccaacgtacatatcataaccatcactggaaatgtaatgcattggtttgctggtcagtttaacttttttcttcgtatgttttctgcggatatagccgctctgcatcagttcctctttgatctgagcaagatccgcttcgttcagagcaatgtcaagtgcgttgctgatagattccagatactggatatcatcggcagtttcctggatcagctccgtcaatgcttcaaatgtacgcttctgtttgttgtattttgcaaaataacgttgtgcattctcgcccggagtctgtgtcggatcaagcgggatagtaatctcttcattagtgtaataattcagggcagtcagttctttggatcccggttccaggttatagccgtaagtattgatcagttctccgtagactttgtatttgtcacgtttttccgttccctttaactgtttggactgtagatcgtactttttccggtttcgttccagtgacgtctggacaacatgacggagatctgcacttttctgatggattctggtcagtgtgttgcgtgtggaatagtacgtataaaggacttccgagatggaagaatactctttgcttatatatccgttaaaatgtgtgacaggaagagcactgaattcttttggcgcattcccattataataaatggctggctgaaagtttccctgtctgacatcttccatgtaataggtgaactggcggtacagatgaattaacgcatcttcggaaagatcatgtgctgtcatggaagagtctacaccggcaaggaagcagatttcttcggcaatgaccggactgatgccggtcatacaggaataaaccgctttagacaccggcatcggttttgcgaggattgcggaaatgaattcttcctgggtaatggtcagaggatttttctttgacatcgtgtccggaataaaataatcgcgtcccggcaatacttcgcgtaccgaactcatctgagcagagacatgcttgatactgtcgatgatgcgtccgtttgtatcacagaaaataatattactgtgttttcccataatttctataattagttttttcctgcacagatcccccatctcatccagatgctcgatatccagatgaataattcgttcaagggacggctgagagacggcggtgatgcgtccgccgccgatatgtttacgcagaagcatacagaatcccggagcggtcatcggacttggtttgttctcatttgttaaataaataagtgggagcgaggcgctggcagagatataaagtctcttctgcccgctgtttccttttattgttaaaagcagttcatcattttccggctgcgcaatcttggagatgcgtccgccgactaaagttttttctaattcctgaacgactgctgcgactgtgattccgtcaaaagccataaaaagaccttcctttccttacagaatttcatatttgtctagtatagcatagttgacgaactttgccaaatgtcttataataaatgctggtttattttaaataatgaataagaagaggatcatatcatgattaagagtatgacaggattcggacgctgcgaagcggctgatgaggaacgtaaattcacggttgagatgaagggagtgaatcatcgttatctggatgccaatatccgtatgccgaagaagcttaatttttttgaaagtgccattcgaagccttttaaaggagagtgttcatcgtggaaaggtggacatctttattacatatgaagacttttcggaaagccaggtttctttaaagtataatgagacgctggcagcagaatatctggaaaagtttaaaatgatggaagaaaaattctcactggagaatgacatccgtgtatccacattgtcccgttatccggaagtccttacaatggaagagaagatggatgatgaagaagaactgtggaaaggacttaagaaagcactggatggtgcgatcgcacagttcgtacagactagaaccgtagagggagagaatctgaagaaggatctgatcgcgaagctggacggtatgcttgaactggtcggacagattgaagaacgtgcaccgaagatcattgcggagtacaaagaaaagctagaaggaaaagtaaaagaacttctggaggacacacagatcgatgagggacggatcgcatcagagatcgtgatctttgcggacaagatctgtaccgatgaagaagtggtacgtctgagaagtcatgtggaacatatgaaggcaacccttcagtctgatgacagtggaatcggacgtaagcttgatttcattgcacaggagatgaaccgtgaagcgaatacgattctttcgaaggcgaatgatctggagacttccaatatcggaatcgaacttaagacagagattgagaaagtcagagagcagatacagaatattgaataaattagattgttaaaagagggtatccaaatgagagaaaaagggattctgatcgttgtatcaggtttttcgggttccggtaaaggaacgattatgaaagaactgttaaaacagtatgataattatgcattatccatttctgcaactaccagaaatccacgtccgggagaaaaagacggacgggagtatttttttaaaacagtagaagattttgaaaaaatgattgcgaaagaagaactgatagagtatgctaggtacgtggataattactatggaacaccacgtgcatatgtagaagagcagctagatgccgggaaagatgtaatccttgagatagaaatccagggtgcattgaaagtgaaagaaaagttcccggacacactgcttctgttcgtgacaccgccgagtgcagaggaacttaagaaccgtctggtaggccgtggtacggagacaatggacgtgattgaattccgcatgaagcgtgcaaaagaagaagcactggagatggatcggtatgactacctgatcgtaaatgatgacctgcaggaatgtgtagaagagatgcatcagatcatccagggtgagcacagaagaagtttccgtaacgctgaatttatagagcatatgaaagaagaattgaaaggagaataagtgtatgttacatccatcttacacagacttaatgaaagtggtaaataaagacgtagaagagggcgaaacaaaagtagttaacagccgttactctatcgttatggccacagcaaagagagcaagagagattattgacggatctatgccgctcgttgatgcaaaggttggcgaaaagccgctttctattgcaattgatgagatgaatcagggaaagatgacgattattgcacaggatgaagaggaagaagaataaaatctgacaccttaaggatccgttgtagacggattctttcagacacattgctgactgagatacaaaaggcagatgccgcaaggtgtctgcctttcttgaactggatatagcaagatagcaaagatgtgtgccgaatagaatgcatactgcaaaaatcagaaataaataaaaaggagaaccgaatgaatatatttttcgtatcacttggctgtgataagaacctggtagattcagaggtcatgcttggacttctggatgcgaaaggataccagattgttgatgatgagacacaggcagatgttatggtgattaatacctgttgttttattcatgacgcaaaagaagaaagtatccagacgattctggatatggcaagatataaagaagaaggaagattaaaggcattggttgtaaccggatgtctggcacagagatataagcaggagattattgatgagatcccggaagttgatgtagtgcttgggacgacttcgtatgataagattgtagaagcagtagaagaagcactggaaggtaaatcagaagtagaacttgccgatatcgatgcgctgccgcttccggagacaaagagacttgtgacgaccggaggtcactatgcatatctgaagattgcagaaggctgtgacaaacactgtacatactgtattatcccgaaagtccgtggaaattaccgcagtgtaccgatggagcgtctgatcaaagaagcacaggaactggctgaccagggcgtaaaagaactgatcctggttgcacaggagacaacggtatatggacaggatatttacggtgaaaaatccctgcataagcttctgaaagagttatgtcagatcaaaggaatccgctggatccgccttctgtactgttatccggaagagattgatgacaatctgatacaggtaatgaaagaagaaccgaagatctgtcattatctggatctcccaatccagcatgcaagcgatgcgatcttaaagagaatgggaagaagaacttccaagcaacagctgatcgatacgatcacaaaactgagaaaagagattccggacatcgcacttcgtacaacgttgatcaccggttttccaggggagacacaggagcagcatgaagaagtaatggaattcgtagatgagatggaatttgaaagactgggcgtatttacttattcgccggaagaagatactccggcggcgaccatgccggatcagatcgacgaagaagtaaaagaagaccgtcaggcagatattatggagctgcagcaggagattgtattcgatcaggcagaagatatgatcggaaaagaagtactggttatgatcgaaggaaaagttgccgatgagaatgcatatgtcggaagaacttaccgcgatgcaccgaatgtagacggactgatttttgtaaataccgatgaagaactgatgactggtgatttcgcaaaagtgaaagttaccggagcagcagaatatgatttgataggagagttgatgtaatgaatttaccaaataagttaactgttttaagagtaatcatggttccgttttttgtgtttttcatgctgacaggcgtgggcggagctgcaaacaaatggatcgcattgattattttctgcgtggcaagtcttacagatatgctggacggaaagatcgccagagccagaaatcttgtaaccaatttcggaaagtttatggatccgctggcagataaactgcttgtatgttcggctatgatctgcatgatcccgcttggaaaactgcaggcatggtttgtaatcgtaattattgcaagagaatttatcatcagcggattccgtctggtagcagcagacaacgatattgtgatcgctgcaagctactggggaaaattcaaaacggtatcccagatgttcatgctgatccttctgatcgcagatcttggcggtgcatttaacatgatcgcacaggtactgatctgggtatctctggtacttacaatcgtatctttgatcgattatattgcaaagaatgtacaggtactgacacagggcggtatgtaggctcagaagaaatttgtaaaaaaggcagataaggattcttttgaaagaaatatgagaaggttcttcttcgggaatggtatttccccgagaagaaccttttgcaaattgtgccaaaaaaagagaaaattccatacaaaaatgtagagaaaaatcaattgacgaatgtcgaaatatatgagaaaataaatacaagtatggatgttaaagagataacaaaccttacgataagcaaacttacatagttgaaaggagttttaaaatgatttattcacaggaagtagaaatgatgtgtccggtagctcagggtgcaaaccacggaccagctccgattccggaagaagcaaaatgggttcaggctaaggaaattaaagatatctctggttttacacatggtgtaggctggtgtgctcctcagcagggtgcctgtaaattaacactgaatgttaaagacggtatcatccaggaggctctcgttgagactatcggatgttcaggaatgacacattcagcagctatggcttctgagattcttccaggaaaaactattttagaggcattaaacacagaccttgtttgtgatgctatcaatacagcaatgcgtgagttattcctgcagatcgtatacggaagaactcagagtgcattctctgaagacggacttgctatcggagccggactggaagacctcggaaaaggacttcgttcacaggttggtacaatgtacggcacattagcgaaaggtcctcgttaccttgaaatggcagaaggatatgtaacaggtatcgctcttgatgagaacgatgagatcattggatatcagttcgtaagccttggaaaattcacagacttcgtaaaagctggagacactccaaacgaagcttgggagaaagcaaaaggacagtacggacgtgttgcagatgcagttaagatcatcgacccacgtaaggagtaatctcaatattttaaggtaatttaatcaggaggataaattaatggctttatttgaatcatatgaaagaagaattgataaaatcaatgaagtattggctggttatggtatttcttctatcgaagaagcacagcagatcacaaaggatgccggacttgatgtatacaatcagatcaaaggtattcagccaatctgttttgaaaatgcatgctgggcatacatcgtaggtgcagcaattgcaatcaaaaaaggatgtaagacagcagcagaagctgcagcagcaatcggagaaggacttcaggctttctgtattcctggatcagttgctgatcagagaaaagtaggtcttggacatggtaacttaggaaagatgcttctggaagaagatacagagtgtttcgcattcctggctggtcatgaatcattcgcagctgctgagggtgctatcggtatcgcagagaaggctaacaaagttcgtaagaaacctcttcgtgttatcctgaacggtcttggaaaagatgctgcaaagatcatctcaagaattaacggattcacatatgttcagacagaatatgattactacacaggagaactgaaagaagtacagagaatctcttactctgacggactccgttctaaagttaactgctacggtgctaacgacgtacgtgaaggtgttgcaatcatgcacaaagaaggcgtggacgtatctatcacaggtaactctacaaacccgacacgtttccagcatccggttgcaggtacatataagaaagaatgtatcgagcagggcaagaagtacttctcagtagcatcaggcggtggtacaggacgtacacttcacccagataacatggctgcaggtccagcttcttacggtatgacagatactcttggacgtatgcactcagatgcacagttcgcaggatcttcatcagtacctgctcacgtagaaatgatgggactgattggagcaggaaacaacccgatggttggtatgactgttgcagttgccgtttccgtagaggaagcagctaaggctggtaagttctaagaaattgaatattcagtttggcttgtataggccggatttgaaaagagagaacaaaaatgttctctctttttttagtgatttaggatttaattgggatttaatttattaactggggaagcggcctctcagtctttgaaggaaacaatagataaggcttcttgttcaggttcccataccataagaaacactaagagagccagaatcacctaaaagcaaaggaactacgctcaaactcggcgttcgcctcaaacacgttcgcttcgttcctttaacggtgcttctgactctctaactgtttctaacggcattccacattcacaataatccttatctattgtttccttcaagtcgtgactggcagcggatgttaataaatgaaatgcccggaagtgtaacccagcggaagccactacggttacgcatttgtcattttattcgtaaggcatttgatacccacggaataaaaagtaggaagccgttccagtgaatgtgaagaaggtgttggaaatagttaagcgtcaaaattatgcgttgggttttcgaaatttgcctgtttgagccgaatggcgagttgcaaatttcggaagcccgtttttagcataattttgacgctttagtatttcccaccgacggaacctgaacaggaacagcttcctactttttatgcaggtccgggtaatcatgccttcctgaattaaatcccaagcaaaattatttgtttaagtttttattcgccgtagaaagcatcagtttcaaccggttcaactggttgacttcgcttgcacctgggtcgaaatcaattgctacgatattagacttcggatagcgtctgcgaagttctttgataactcccttacctacgacatggttcggcaggcaggcgaatggctgtgtacatacgatatttggcgcaccactgtggatcagctctaacatttctcctgtaaggaaccatccttcaccagtctggttaccaagagatacgatgtccgaagccatctttccaagatcctggatcttagctggcggtgtgaagtgcttgcttgctgcaaatgcttcagttgccggagcacggaaccattccagaactttgataccaagattagctgttgtggcttttttcttttcgaatccaagcttttcaaccttgaagttctggttgtagaagcagtagagcaggaagtccagaagatccgggacaacagcttcggctccttcactttccaggaggtctaccaggtagttattggcagccggaaggaatttgacgagaatttcgccgacaacaccgacacgaggtttcttaatgtccagtaattcaatgttgttgtcaaaatctccaatgatctcacggcagagacgtttgaatttacgcctgctcgggtagccgttagacaagaagtcctggcatactttcacccattttctgtgcattgcattgacagatccggtaactgcttcatatggacgcagacggtatacacatttcataaaaatgtcaccgaatatagcaccatagatgcctcgtaagatcagcttcggagtcagcttgaatcccggattgtcttccagaccgcttaagttgatggagataaccggaatatttccgtatccggccttcttaagagcacggcggatgaatccgatgtagttggaagcacggcatccaccgccggtttgactgatgatcacagcgattttatctgtatcatatttaccggaaagaatcgcttccatgatctgaccgactaccatcagagatggatagcaggcatcattgtttacatatttcaggcctacgtctacagcctgtttgttgtcattaggcaatacctgaaggttatatccggatgcgttgaatgcaggctccagaagctcgaaatggatgggagacatctgtgggcagagaattgtataattcttacgcatttctttggtgaatacgaccttttttattgcagaagaatgaatggtacgtttttccccacgtttctctctgacacggattgcggcaagcagtgatctgacacggattcttgcggcacctaagttattcacttcatcaattttcaaagaagtgtagatcttatcagagtcattcaggatcgatgctacctgatcagtcgtaacagcatccagaccacatccgaaagaatttaactggatcagatccagattatctaccgtctttacgtagtttgctgcggcatacagacgggaatgatacatccactggtccataacattgagcggatgctcggcaggatttaagtgggagatggaatcttccgtcagaactgcaatattataagaattgatcagttcgggaataccatggtttacctccggatcgatgtgatacggacgtcctgcaagaacaataccacggtttccggtttcgtttaagaacctgatcgtctcttcaccttttttctgcatatcttttctgcatgcagcgagttcttcccaggcagtatgcgttgcttttttgatctcgtcagccgggatatggaactttccggataattcatcaaccagccggtaagagatggtgtcttcgctggtaaaagaaataaatggatgaagaaaatctacttctccgtgaacaattgcatcaatgttgtttttgatattttccgggtaggaagttacgatcggacagttgtaatggttattggcttccgcaaattcattcctctcatatggaatgctgggataaaagatggtgtggataccgttgttgatcagccattgtacatgtccgtgtgccagctttgccggataacattcggattcacttgggatggaatcaattcccagttcgtataccttgcggtttgacacaggagaaagaataacccgaaatcccagttcattaaagaatgtgaaccagaacgggtaattctcgtacatgttcagtacacgaggaataccaatgattccgcgaggagcattttcctctgccaatggttcataatcaaaatagcgttttaatttatattcaaataagttcggaagcttgttagttgttttctgtttcccgagaccacgttcacaacggttacctgtgatgaacttacgtccgccgctgaaatgattgatcgtcaggcggcagttattcgtacatcccttgcattttgtcatagtagtagaatattccatggcttcaatatcttcgatggaaagcatggttgtaccttcgcagtcaacgtaacgctcacgtgcgatcagtgcagcaccgaatgcgcccatgataccggcaatatccggacgaatggcttcgcagttggcaatcttttcaaagctccgcagtacagcgttgttgtagaatgttcctccctgaacaacgatgtgtttaccgagttcagatgcatcggacaccttgataactttaaataatgcgttcttgattacggagtaagcaagaccggctgaaatatctgcaacctccgcaccctctttctgagcctgttttacttttgaattcatgaaaacagtacagcgggtaccaaggtcaatcgggtttttggcaaataatgcttcatgagcaaaatcttctaccgtataatttagagattttgcaaatgtttcaataaaagaaccgcatccggatgaacatgcttcattcaattgtacgctgtcaaccgtctgattcttgatcttgatacatttcatatcctggcctccgatatccaggatacaatctacatccggttcaaagaaggatgcggcatagtaatgagaaactgtctctacctctccttcgtctaacaggagggcagctttgatcagtgcctcaccatagccggtagagcaggagtgaacaatctccacgccttccggcagtttactgtaaatatctttgatggcagagatcgttgtaccaagaggatctccttcattattatgatagaaagaatataataaagtaccgtcttcgcctaccagggcagctttggttgtggtggaacctgcatcaataccaaggaatgcttttccctgataagtggcaagatccttcacaggtacctgatgttttgcatgacggttttcgaattctttaaaatctgcttccgttgcaaacagcggctccatacgatccacttcgaattccattttgatctttccttccagacggtgctgcatatcaatgagaggcacgtccagatctttctttgaattcagagcagaaccggctgctgcaaacagatgggaatgtgtcggggcgatgatgtgttcatcgtccagcttcagtgtgcggatgaaagcttcgcgcagttcagagaggaaatgaagaggtcctcctaagaatgcaacatgtccgcagattggtttaccacaggccagtccgctgatagtctggttgacaactgcctggaatatagaagcagcaaggtcttctttggcagcaccatcattgatcagaggctggatatccgtcttggcaaatacaccacatcgtgcagcaatggtatagagagctttataattttttgcatattcgttcagtccggaggcgtcagtctgtaaaagagatgccatctgatcgatgaaggatcctgtaccaccggcacagacgccgttcatacgctgctctacattaccaccttcaaagtagataatcttggcatcttctccgccgagttcgatagcaacgtctgtctgaggtgcatagtcctggagagcagtagatacagcgatcacttcctgtacaaacggtacaccaagatgtttcgcaagagtcagtccgccggaaccggtaatgaccggtgatgcatggacaggacctaatttatgtaccgctcttcctaacagatcggaaagagtttcctggatgttcgcgaaatgcctctcataatcagaaaataccacttcattattctcatctaatatggcaatctttacggttgtagaaccgatgtcgataccaagtgcgtataattctttttgattcatattatgtaactccttatcatgttgatctatatgtctttcttcttattaaatgcattttgcttaattgcaacctgtaacattatacgacaaaagttctcaaaagacaattaacaaatgttgaagatatgttaaaaagagatgaactttacttggcacaattgacaaatatcagttgggaaggtagaatatctacagtgtgagaataaacgtaaaggagcagttatatgaacaattggttagataaacttgaacggaaatttagcagatatgctattccaaatttgatcacatatattataatattatatgcagccggatttgcgctggagttgattaacccgacgttctatagccagttcttaagtctggatgccagcaagattctccaggggcagatatggagaattgttacatttattatccagcctccgtctgacagtctgatctttattgcatttgcactgtatctctattatatgatagggaagcagttagaggcagcgtggggggcgtttcgttttaatctgtatttcttttcgggaatgctctttattgtactgggagccatactggcatatttactgacaggcactgtgttaccaatggatacatggtatctgaatttatcgttattctttgcatttgcagcactgtatccggatatccagctgttattatttttcgttattccgattaagatcaaatggctggctatacttgatggcttgtattttatctatgcgattgtgcaggcttttcttccggcctacggcggagatgttttcggtatatattataaggcaaatgcgcttgcagcatttatcgcaatactgaactttatcatttttttcctgagttcacgtaatatgaagccttacacaccaggtcagatgaaaagaaagaatgatttcaaacgcaagatgagacatgcggaaagaccggtaaacagctatgcaaatggggcaaaacacagatgcgcagtctgcggaagaacagaactggatgatccgaatctggaattccggtattgttcaaaatgtaatggcaattatgaatattgccaggatcatttgttcacacatacacatgttaaataatcaagagaggaataggagaaatatgaaaaaaacaaaaattatctgtacaatgggaccaaatacaaatgatgaaaccctgatgagaaagttagttcagaatggaatggacattgcaagatttaacttttcacacggtgatcacgaagaacagaagggccgtatggatatgttaaagaagattcgtgaagaagagaacaaaccgatcgcaattcttctggatacaaaaggacctgagatccgtacaggtgtattaaaagatggaaagaaagtacagcttgaagcaggagagatatttaccctgacaacagacgagattgtcggagataacaagattgtttctattacatacaaaggtctggtagaagatgtcaaagccggaagtacgatcctgatcgatgatggtctgattgaattgaaagtaaaagataaaaagggaaataacatcaattgcgaaattgtcaatggcggcgagctcggagaaaagaaaggtgttaatgtaccaaacgttgcgatccgtcttccagctatcacagataaagaccgtgatgacctgaaattcggtgtggagcagggtgtagattttattgcagcttcatttgtcagaaatgcagaatgtattctggagatcaaatcattcttaagagaatgtaaggctccgtatatccctgtaattgcaaaaatcgagaactttgaagcaatcaagaatattgatgagattatccgttgcgcagacggaatcatggtagccagaggagatcttggtgttgaaattccggcagaggaagttccataccttcagaagacaattatccagaaatgtaacgataactttaaaccggttatcacagctacgcagatgcttgattctatgatgcgtaatccacgtcctacaagagcagaggttacagatgttgccaatgcggtatatgacggaacagatgcagtcatgctttctggagagacagctcagggtaaatatccgttagaagctttacagatgatggttcatattgttgaaaatacagaggagcatctggattatgatatgatccttagaaaagcaggagaacacagacttaagagtgcatccagcgcacttgcaaatgcaacagtaacaacggctaataatcttcgtgctaaatgtatcgtaacaccaactgtatcaggtgctacggcaagagttgtatctaagttcaaacctaagacaggtattatcggtatcagcccggatgaggcaacactgagaagaatgcagatcaactggggagttatgccgctgaaatcagttgctgtatatacaacagaagatatctgtgatactgcaatcgatctgatctgtgcaaagaagcttgcagaagcaggagacatggttgtattaacgcttggaattccatctacaaatgtatctgagaacagaacagtaagtaacatgatgagaattgcgatggtagatgacagaaaataaaaatagtaaataagcaggactgcttataaagaaccagaaagcaatgaggctgaatcagcctgggccttctggttctttgcatgtttttgagaaagtttctccttgacatacagcgaaaattcacttatagtgttcctgtagagaactactaaagaatcaaaaggtggatgacgaagatggaacagacatcatttacagagcgcctgatggaattcggactcacaagacaagaagcaagcatttatcagtgcctgctgacagagggaaaggtaactggatacgaagttgctaaacagaccggaatatccagatccaatgcatataattctctggctagtatgacagagaaaggtgcggcttaccttgtagaagaggccagtaccagaaaatatgtgcctgtcccgcttaacgaattctgtaagaatcgtatccgtaagctggaggaatccggaaaatggctgcaggaacatatgccgacggagaaagcgtatgtagaaggatacattacaattgaaggcgcagagaatatactgaataagataaagaatctgttatctcaggttgatcagagagtctatatcagttgtacaagaaattatctgctgcttctgatccgggagcttgatacattgatggaagaaagaaaaaaagtggtgatcatcaccgatcaaccggcgacctttcacaatgcaaaagtatattttggagaaaacagaggaatgcagataggaatcattgccgattcgaaatatgtactgacaggtgaatacggagaggggagtatgaatacatgtctctattccggacagaaaaactttgtagaattgtacaaaacagcacttgcgaatgagataaagttattatctatacgagaggagaacaaggattgatgaaaaaagaaccatttgtaacaaaagcacagttagacgagattattaaaacttatccgacaccgtttcatttatatgacgaaaaaggaatccgtgagaatatgaaagctttaaaagaagcattttcgtggaataaaggatacagagagtattttgcggtaaaggcaacgccaaatccatttctgatcaatattttaagagagtatggatgtggatgtgactgttcttcctatacagaactgatgctttccgatgcaattggggcaacaggagaagatatcatgttttcttcgaatgatactccggcagaggaatttgtactggcagacaagctgaatgcaatcatcaatctggatgacatcacacacattgatttccttgaagaagcaatcggacatattccggagacgatcagctgccgctacaatccgggtggaatgttcaagatcagtaatgacatcatggataatccgggagatgcgaaatatggaatgacaacagaacagttatttgatgcatttaagattttaaagggaaaaggtgccaaagaattcggcattcatgcattccttgcaagtaatacagtaaccaatgagtattatccgatgcttgcgaaagttctgttcgaagttgcagtaaagcttcagaaagaaacaggtgtacatatcaaatttattaacctgtccggtggtgtaggtatcccttataaaccagatcaggagccaaatgatatccgtgcgattggtgacggtgtgcgccgcgtatatgaagaagtactggtacctgccggtatgggtgatgtagcgatctatacagagatgggacgttttatgatgggaccttacggatgcctggttacaacggcaattcatgaaaagcatacacacaaagaatatattggtgtagatgcatgtgcagttaacctgatgcgtcctgctatgtacggagcttatcatcacattactgtaatgggtaaagaaaatgcaccttgcgatcacaaatatgatataacaggatcgttgtgtgaaaacaatgataaatttgcaatcgaccgtatgcttccgaagattgatatgggtgatgtgctggtaattcatgatacgggagcacatggcttctctatgggatataattacaatggaaaattaaaatctgccgaagtgcttctgaaagaagacgggactacacaactgatcagaagagcagaaacaccggctgattatttcgcaacattcgactgctttgatatcggaaaaaaactgattgaaaaatagttgtggaaaaaatcaggtttagatataatgatagtgtcctttcaattaagaaacgggcactatcattttttatgaggaggcaataaaatgaaaaaacatggtgtactggcgctggtgctggccggagtgatgttactgttatgcggatgtggaggtatgacaacggacgatgcaatggattatgtacagtctgccttggattgtggatacaaagcagaagttaagaagtatgccgagataacagagacgacagaaaaagaagccaaaaaagaatacgagacaaatcttgatacgattatgaaagaagccggttttgatgacaccggtgtatcggatgaattaaaagcggactatcgttcgatgtttgaaaaaatgttaaagagtgcaaattataaagtgaaagaagcaaaagaaacagaagatgatgaatttactgtaactgttgaagtgtgtccgtttacggcattttctactgtatcagatgagcttgatcaatgggtgacagacacatattcgaatgtagaatcaatcccgtcagatgaagaacttaatgaggcaatcatgcggaagatgtatgaaattatgagtgcaaaacttgcagacccgacgtatggcgataagatggaaaaagaagttcacgtaaaggtgaataaagacggagcatattatattccgaatgatgatctcacggcagtagatgatgcactgttcccgcagaatcagctttaggtttcggttaataaaatatgaattaaaaactatgtacaacacagatttgggggattgacatctctggaatctgtgttgtattatatacaaaaataattgaataacattctgttgttcggtcttatttaatttcagataaatgatcaaaaggcaggtcatgcttctcatatgacgttgccagataacccatttataatctatccaagtgaatatggaataatctgacagattttacgttgtgtttgacatggaaaggaggtatttacaacggtcggattaatataaataacaagaaagagaggaattgtatgacgaagattcaaaaaagtaagaaaacgatagcttcgttactggcagggatattgctatgtcaggtctctgcgtttggcatgtcacagaccagtgtgaatgcggaaaatccggcaaggaagatgagttttgaagttgtaggagaaggttccgtaacagtaacagatgtagaggattgtataagaacggtccaatcaggcagtgaaataacagtgcctgatggaatgtgtatacgtgtacaatcagatgcagaagaagacaccaggatcagcatgaagatacttgatgaagaaggcagatacgagctggaagacacttcggtgacagaggggaagagttactggcgtgatattacagctatgggtatgaacaagaaagtagtcataacattcggggaagaagcagaaagaagcggtgtatattcaagaagaatggtacaggcgcggggaaatcagcaaaagccggaagtaggggatgtatttaccggaaattgtgtggtcacggctgtgaatggtggaaacggtcatacggtacacggggtaaccatgggcggatttaccggaatccttgccggcgttactgcaaacggagggtgtgcggatcatacggctgctgcgccatatacagggcaggaatgcacctataaatacaccatcactgcagtgaataaagcaacgggagaagttacaggaaacttatactgtacgagtgtgactggggcaacggatggcgtgacaaaagacagcagcggcaggctgatcgggtatcagagagtcagcggaactgccgtcatacaccgcagttacaacgggtatgcaaagttaaaaaaaggaaagacactgacaacgcttacagatggtaatgcagaatattctttggaaggtgcagcctacggagtctattcagatcgtggcgcaacgaaagaaaacgctgtatttacaacggacaaaaacggagagtctaatacgctggaattagaagaaggtatgtattatgtaaaagaaaagaaagcaccaaaaggatataaactggatgataggatatatccggtaacagttacatccggacagacagcagaagtaaatgtgaaggatgtaccggtgtattcagatatagaattgctcctggataaaatcgatcaggagagcaaagagggaaaagcacttggcggtggaagcctggaaggtgcagagtttacagtacgcttttatgcaggcagatatacgcaggattctttgcctgaaaaaccttcgaaagtatgggtgttacgtaccaaaaaggagaatgacgtctgcagaagtaaactgggaaaagagtatcagatatccggtgatgatttttattatgcagaaaatggagataagccggtgcttccgcttggaacagtcagcattgaagaaaccaaagcgccaaaaggatatatgctggaacaggcttatatagaaggagataacggaaaacttgcagaaaattattacctgacacagatcgttcagaatggaaatcagaccaatatacagggtggaaacaactataaaatagcagaccgtatatgtagaggggatattgaatttcagaaaaaagatgaagaaacacagatggcaatggcaggaattccgtttcagatcacatcggtaacgacgggtgaatgtcaccggatcatgacagacgaaaatggatatttttcatcggcatctgattatacgaaacacagaaaagataccaatagcggacaatctgaaagtggtgtgtggtttggaacgaacagtaacggagaaagtgtagaggtaaatgatgcatatggtgcatttccttatgatacctatcggttggaagaacttcgctgtgaagaaaatgtagataaagttctgtataaaggaacattccgtatttccagggaccggtatgttgttgatcttgggacaatacttaatccagatcttacaattgcaacatcagcaaaagatgaagcaaccggaacacattattcaaatgcagatgaaaaagtaacgatcatagatactgtcacttatacaggtttgaaaaaagggcaggaatatgtcatgaagggtacattgatggacagggaaacaggggaaatgattctggatggcgaaaacagaaatattactgcttttaagagatttaagccgaagacagccgaaggcagtgtggaagtgaaatttgaatttgatgcaaagtctctggccggaaaaagtattactatatttgaagaatgcatgttggataatatagtgatcgcagtgcataaggatctggacgatgcagatcagatgattcatttcccaaaattaaaaacttctgtaaaagacgaagtaacagatatgaagatggtaaaagctgagaaagatatgcggattatagatacggtagaatatcataatctgaaaaaagggaaaaaatacaagattaccggaacgttaatggataaggaaacaggaaaagcagcaagaggtgcgtctggcagaaagataacagaaagtgtagaatttgttgcagaaggaaaagacggaacagcggaagtagaatttgtgtttgatggaagtaattttgcaggaaagacattggtcgcatttgaaaaattatattatggtgataaattatatgcagtacatacagatctggaagatgaagatcagacaatccatgtgccgtcagcagggacaacggcttctgaaaaaaatacagggacacatcatgcatatgccggtgaatatgtagaacttacagatacgatagaatacaggaatctactgcctggtgaaacctacacattacatggaacggtagtcgagaaggagacagaacagcggttgagtgaagaaaaacagcaggaatttattccggaaaaggcagatggcagtattgaaattgcatttgaaatcaacggaactgatctgtcgggaaaaacggcagtcatatatgaagagattaaaatagacggaaaaagcatcgcagaacataaagatccggaggcaaaagaacaaagtatttatttcccgaagattggtacaaaagctatggataaaaagtcaaagacgcaggaaggagatgcaagagaaaagcagacaatcatagatcaggtgtcttatgaaaatctgctgcctggcgaaacttacatattaaaaggcgttttgatggataaagcggacgggaaagaaatgacagataaaaacaacagaaaaatcacaggcagaacaacatttacgccggaaaaatcagcaggaacagtcgaaatgacattcgaacttgatgcacgtgaattgggcgggaaagcggttgtggtatttgagaatctgtatgatgaggaagatcatctgattgcagatgaagcgaatatagataatgcggatcagacaattatatataagaataatgaaaaatctgcagtatcgccgaaaatcaacacagacaatccgaaaccatcttcatccatccgtaaatcaccgaagacaggagtggaaaatcatacatttttatggatgttgacgcttggatctctgggaacagcggttgcggccggaattgcaatttatagaaaaaaacgggattgatgaaagttaagcactagcggaagaaaatagaatcttctgttagtgctttttgtataaaaaaagaaacatttacttcttacgaaaccatagtaataaaaatggtaaaaatagtaaatgtcccaatctttaaaatccttgattatactgttttttgactgcggatagtgggacttgaacccacacgaagtcacctccgcaagattttgagtcttgtgcgtctgccattccgccatatccgcatatgtgttgttcacacaacaaaataaattataactataaatgtatcgtctgtcaatctttttttaaaaaaaagaaaaggtgaatgtacagataagggaagaataagtaggagtaaaaattagccttttaaaaagaagcaaattggtgtatagtaagatagtgattttataagaaaatgaactatttaggtggagagataaaatgagcagtaaaattgttctgatagatggccacagtattttgaaccgtgccttttacgggctgccggatctgacgaatgcagaaggccttcatacaaatgcaatatatggatttctgacgattatgtttaaacttctggaagaagaaaaaccagactatctgacggtggcatttgatgtccatgctccgactttcagacataaaatgtatgcagaatataaaggcaccagaaagccgatggctgatgaactaaggcagcaggttcctgtgatcaaagaagtgcttcaggcaatgggagtgaagacgatcgaatgtgcgggtctggaggccgatgacctgatcggtacactttccaagcgttgtgagcgcaaggatatggaagttgtggttatttccggagaccgtgatctgttgcagttggcgactgagcatgtaaagattcgaattccgaagacaaagcagggcagaacggagatagaagattactatgccaaagatgtttttgaacgctatcaggtgacaccggaagaattcatcgatctgaaagcgttaatgggcgacacggcagataatattccgggagttcctggtatcggggaaaagacagcgacaaagatcattacacagtatcactcgatagaaacggcgcacgatcatgtggaagaactgaagccgccgagagcgtctaaatcattaaatgaatactgggatcttgcggtgctcagcaaagaacttgcaacaatcaatgtgaatgctgagttttcatatgaactttcagaagcaaaactgggtaacatatacactgaggaagcatatgtcttctttcagaaactagagtttaaaaatcttctttccagatttgatgttgcggcaccggcaaataagatcgaggatggtttcaggattatcacttcaaaaagagaggcagaagagatttttgcaaaggctgaaaaggcacagacgacaggaacagtactttttaaagatatggaaaatgtattgccgttatttgcagatcaggccggactcggaggtatcggtctgtgcttctcaaatgaagcaggcttttgtataaaaaccgggaatgatatatcaggagaatggcttttggaaaagcttgcagatgtggcagaagcgacagatacattttcgatgtttcatctgaaagaatcaatggatcagattaagatccggaaaccggaaaattgttttgatgtgagtgtggctgcatatctgctgaatccacttaagaataattatacatgggaagatgttgcgagagaacatctggacctgatggttgatgaaaaggcagatcaggaaataaaggcctgctatgaagcttatacaaattatgcatcggtagaagtcctgagccggaaattagcggatacgaagatggataccttattccgggaaattgagatgccgctggtatttacattgttcgatatggagcagaatggtatccgcgttgaggcagaggcattaaaacagtatggcaatcagctcgccggcaagatcgctgatctagaaaaggagatctacgaagaggctggcgaaacatttaatattaattcgccaaaacagctgggtgtggtattgtttgaaaatatgaagcttccgggtgggcgaaagacaaagacgggttattccactgctgcagatgttcttgaaaaactggcgccggaacatccggtagttgcaaagattttggaatacagacagtatacaaagctcaaatccacatatgcggacggactggcaaattatattcaggatgatggaagaattcatggaaaattcaatcagacgatcacggcaaccggaagaatcagcagtacagaaccaaatcttcagaatattccggtgcggatggagcttggccgcctgatccgtaaagtattcattccggaagatggataccggttcgtggatgccgattattcacagatcgaacttcgcgtattggcacattgttccggagatgagcatctgatccgggcatataaagaacaaagtgacattcaccgtattacagcctcacaggtatttcatataccgtttgacgaggtgactccgcagcagagaaggaatgctaaagccgtaaatttcggtattgtgtatggaatcagttcatttggacttagtcaggatctgagcattacacgaaaagaggctgcaaaatatattgatgattattttgcaacctatccgggaatcaagacatttctggatcatgcagtgacacatgcaaaagaagaagggtatgtggtaacactgttcggaagaagacgtccggttccggagctttcttccagtaattttatgcaacgttcgtttggagagcgggtggcaatgaattctccgattcagggagcggcagcagatatcataaagattgcaatgatccgggtgaatcagaaactgaaaaaacagaagatgaaatcaagacttgtcttacaggtgcatgatgaacttctgatagaagcatacgaaccggaactggaagcagttcaaaagattttaaaagaagagatggagcatgcggccaaattaaaggtgccgcttgaaatagacatgcatacaggagtgaactggtacgaagcaaaataagaggtgtgagagatgaagattataggaattaccggaggagtaggcgcagggaaaacacagattttggaatatctgaataataaatatggtgcgactatttgtatggcagatgaagtaggaaagaaactgcagaaaaaaggaacagaatgctttgatgaaattgttgcacatttcggagaggaaattctggatgaaaaaggagagttggaccggacaaagctttcagacattgtttttgccgacagggttgaactttctgtactgaatgggattgtacatccaaaagtaaaagaagaaattcagaagaagattgcaagagaagaacgcaaaagtacgaatctgatgctgattgaaggagcacttctgatcgaggatcattatgaggagatctgtgatgaactttggtatgtgtatgtggaagattccatccgaagaaaacgtctgaaatatgcaagaggatacgaggactgtaaggtggatcagatttttgaagcacagcttccgaaagatctgttcatgcgtcactgtgaccgggtgatcgacaacagcggacagtttgaagagacaaagatccagctgaataagatcatagaagacttatagaaaggcagataatatttaatatgagattatgcagtattgcaagtggaagcagtggaaactgtatctatataggagatgatcagactcatcttctggttgataccggtatcagcaagaaaaggatagaagaagggttggcaaaattggagataaaaggagatgaactggaaggtatcctgatcacacatgaacatgtggatcatattcagggacttggtgtgttcagcagaaaatatgagattccaatctatgcgacacccggaactattgcgggaatccgtaattataaaaaattaggaaaccttccggatggactattacacgaggtagatatagatcagccattttcactgggaacactgaatattgatccgtttgcaatctcccatgatgcgaacgaaccatccggataccggatagataatgggaaaaaggtagttgcagttgcaacagaccttggaatatatgatgattataccgtagaacatctaaaagatttgaatgcggtcgttctggaagcaaatcatgacatacatatgttagaagtaggaccatatccataccccctgaaacggagagttatgggagataagggacatctgtctaacgaattgtcaggaaagcttctttgcgatatattacatgatgacttgcagtatgtcgttcttggacatttaagtaaagagaataattatgaagaactggcatatgagacggtcagactggaaatcagcattggtgataatccttataagggaaatgacattccgatgatggtagctaaacgggatcaggtatctgatatcattgcattataagaaagaaacaatggcgaagacaataggaggaaaacaaatcatgaagaaatgtgtaatcacagttgtaggaaaagacaccgtaggtattattgcaaaagtatgtgagtatcttgcaggagcaaatgttaatatccttgatatctctcagaccatcgtagatggatactttaatatgatgacgattgttgatgtaacaaattgcagcaaagaagtggctgtggtttcaaaggagctggaagagatcggaacttctatcggtgttgccattcactgtcagagagaagaaatatttgaaaaaatgcacagattataagcaaattaaaaatatttacggaaaggcaggaaaaacacatgataaacagatatgaagtatatgagacaaatcagatgattgcagaggagaatctggatgtacgtacaattacccttggaatcagcctgttggattgtatagatgcagaccttgataaattaaatgaaaatatttacaacaaaatcactaccgttgcgaaagatcttgtgaagaccggagaggagatcgagcaggaatttggtattccgatcgttaataaacgaatctccataacaccggtagcactgatcggcggtgcggcatgcaaaagtcctgaggattttgttacgattgcaaagacattggataaagctgcaaaagaagtcggtgtaaacttcatcggtggttattcggcgctggtgtcaaagtctatgacaaaaagcgatgagaacctgatccgctcggttccgcaggcacttgcatgtacagaccgtatctgcagctcgatcaatgtgggatcaacgaagaccggtattaacatggatgcagtacgtctgtgtggcgaaattgtaaagaagacagctgaagcaacaaaagaaaatgattctctcggatgtgcaaaacttgtagtattctgtaacgcgccggacgataatccatttatggcaggtgcattccttggtgtaacagaaggagatgctgtgatcaatgtcggtgtcagcggacctggtgttgtaaagcatgcgattgaacaggtgcggggcaaaggcttcgaagagttatgtgagacgattaaaaagacagcatttaaggtgactcgtgtcggacagttggttgccggagaagcatccaaacgtcttggtattccatttggaattattgatctgtcactggcaccgactccggcaattggagacagcgtcgcagagattttggaagaaatcggtctggaacgtgttggtgcgccgggaacgacggcagcgcttgcaatgttaaatgatcaggttaaaaagggcggtgttatggcttcttcttacgtaggcggactgagtggtgcttttatccctgtaagtgaagataaaggtatgatcgatgcagtggaaatgggtgcactcacaattgaaaaactggaagcaatgacatgtgtatgttcggtaggacttgatatgattgcgattccgggtaagacaagtgcttctactatttctggaattattgcagatgagatggcaattggtatggtgaaccagaagacgaccgcagtacgtctgattccggttattggaaaagatgtcggagagacggcagaatttggtgggcttctcggttatgcaccaatcattccggtcaatgaatatgactgcagtgcatttgtgaatagaaaaggaagaatccctgctcctgtacacagctttaagaactaaaaagagaacagagctataagaaaaacgtgtagcatatgataatgaatacaatttatattatcatatgctacacgtttttgtgcctggacaggaaaggagcgctgctgacggaagaatgatttatatactatacatgtatgatctgcttttggtattcgtttatgaaaggaattccgaacttgtcggacactacgctttcgtacagatctgatgcaaaagtggtctgatccagcattcgtattgtttccggaagaagcgaatctgtctgccctaattttgtaataaccggaatgctggcgttttcttttatctgacgcagcacatcggcatgttctttacgaaatccaagaattctggtatagatgcaggaagattcccggtatctcaacatatcttctttttttacggctaacagaatatgcagcagacctctgctgatacggctgtaagtcagttcttttgtttttaaaagctgacagaactgttcgaagttcagaaactgattccggtttcggatgatacggtttgcaagatcctcggatatatcctgatactcacatagagatctccgggtttcgcagagcaggcggtattttaataaaagggagaaatcatttgtttcaatgggacaagattgattccatgcatcccgtaacagacgcagggcgttttcaggaagctggttctgcaacagttcggagaatccgtccggtgtctgctgaggatctgccggatatctgctgaatggctgctcctcccaatgtctcagggcattccgaatggcagaggcggaacttgactgtggctgaagttttgtgtcatggtatccggaagagtcccgctttaacgtatatggtaccatcctgctgttctgcttttttagtgctttcagatattcaatcccaagaatattattgggttcagaaagaatctgtgaaacggaagcatcaccggttaatttttccaaagcctggtgtctggcggcaggaaaagaatgtcctttttttaatgcatcctgaagcatatggctgtaagtatctgattcggagagaagcagctgtgcaatatgctgtaaaacagaaagctctccgcattcacttccaaagcataatgtatcgatgcatcccagaccttccagaatagagatggcgccttgggcgaagaattcggcactgccggatgcatagcagacaggaagctcgcagatagccgatgcgccgtttagaagtgccatatgcgcacgggaatgcttggatagaagcgcaggagttccgcgctgtacataatcgccgctcatgacgattacaacccggtcggcaccggttagttccctggctctttctatatgataaagatgtccgttgtgaaatgggttatattctgtaataagtccaacagttttcatgaaaatctccttgtataacattctgaaattgattatactatacaatgatttggtacgcaaatgggatgtttgccgggcaagatccgaagaaaggagggggcatattatatggaagaaaatatgaatgaggaagccttaacggcagacgggcaaaaagacgatgatattgattatgtagaagacagagaagaactgactgaagaacgtattaaggatatgctggatgcccgggaatataaagaattgaaagaagaactggaaacaaatatgtatccggtggatcttgcggagattctggaagaatttgatcagaaacacatggtgctggtattccgtctgcttgcaaaagaagaagcggcagagacattttcatatatgaacagcgatatgcgcgaagacctgatcaatgcactgacggattccgaactggaagagatcatggaggaaatgtatctggatgataccgttgatgtgctggaagagatgcctgccaacgtggtagacagactgctgatggtgacagatgcggaaaaacgtcagcagatcaatcagcttcttcagtatccggaggacagtgccggaagtgtgatgaatgtagattatattgcactgcgaagagagatgacggttgctgattccatattaaaaataagacaggttggtctcaaccgggagacgatttatacctgttatgtaacagaacaacgtcatctgatcgggcaggttgacataaaagaactgctgaccagcagtgaatccaagacggttgaagagatcatggatacaaatatgttgtatgcccgtacgacagacgatcaggaagacgttgccaatatcattacaaaatatggtctgatcgcattgccgatcgtagatcatgaaaactgtatggtcggtattgtaaccgttgatgatgcgatgcaggtacttcaggatgagacaacggaagatatcagcatcatggccggtgtcaatccaaatgaagactcgtatttcgggacatcaatattcgagcatgtaaagagccgtattccctggctgttgtttctgatgctgtctgcgacggtaacacagatgatcatgaacagctacgagaatgcactggcactgatgccgcagcttgcaggatttgttccgatgcttaccggaaccggaggaaactgtggatcgcagagctcgacacttgtgatccgtggacttgctgtcggagagattgaattttcggatctgtttaaagtaatctggaaagaaatccgcattgcattctgcatcagcatcatactgtctgtggtaaatggaatccgtatcatgttgatgggacagggagatgccatgatggcatttaccattggtctgacgatggcttgtacagtgttgatcgcaaaagtagtcggatgtacactccctctgatcgctaagaaaatcggacttgatccggcaatcatggcgacaccgctgatctctacactggttgatatcagcacgatcagtgtatattttgcgattgtgagttacgtatttcgcttataacactgtgaaattgcaatagtttttgtcaaaagcaggataaatattgtacattgtacgcaaaaagagacataagattaccgtaagagcccttgtccgcaagggctctttgtattataatgaaaatactgagaaaaatatttggaaaggagtctatttatcatgggatttatagatgaaatcaaagcaaaagcaaaaagttgtaaaaaaacaatcgttcttccagagagcgaagacatcagaacttatgaggcagcagaggcaatcttaaaagaagggacagctaatctggtcctgatcggaagcgaagaagagatcgctaagaataaaggggatttcgatatcacaggagcaacaatcgttgaccctgctacatacgagaaaacagatgaatatgtagcaacacttgttgaactgagaaagaaaaaaggaatgacagaagaacaggcaagagagattcttcttactaattacttatactatggtgtaatgatggttaagatgaaagatgcagacggaatggtatcaggagcatgccactctacagctgacacacttcgtccatgccttcagatcctgaagacaaaaccaggaacaaagcttgtatctgcattctttgttatggtagtacctgactgcgacatgggagagaacggaacatttgtattcgctgactgcggactgaaccagaatcctacatccgaagagcttgcagcaattgctcagtcttcagcagaaagcttcaaacagctcgttggtgctgatccaagagttgctatgctttcttactcaacaatgggaagtgcaaaacacgatgacgtaacaaaagtacaggaagctgttaagatcgcaaaagctgagaatccggatcttatgttagacggagagatgcagcttgatgcagcacttgttccttctgttggagcagctaaagcaccaggaagtcaggttgcaggaaaagccaatactctgatcttccctaaccttgatgcaggtaacattggatacaaacttgttcagcgtctcgcaaaagcagaagcttacggaccaatgacacagggaatcgcagcacctgttaacgacctttcaagaggatgcagtgctaaggatattgaaggtgttgttgcaatcacagcagttcagtgccagaatcagtaagagataaagtaagaggagaaataatatgaaagtattagtaatgaactgcggaagttcatctttaaaatatcagttgatcgacatggagaacgagagcgttcttgcaaaaggtatctgtgaaagaatcggagccgatggatctgtattaacacacaaaccaacaggaaaagataaatatgttgtagagcaggcaatgccagatcatggtgtagcagtacagttagtactggatgctttacaggataaagagcatggtgtgatcgaaagtgcggatgagattacagcaatcggacaccgtgtactgcatgcaggtactatttacagtgatgcaacacttgtaacagaagacgtgaagaaagttgttcgtgactgcttcgacctcggacctcttcataaccctgcaaacctgatcggtattgaagcttgcgaaaaagcaatgcctggcaaaccgaatgtagcagtattcgatacagcatttggtatgaatattccaaagaaagcagctatgtatgcaatcccatatgaatattatgagaaatacagcatcagaagatatggtttccacggaacaagccatatgttcgtatctggtgaaactgtaaaacttcttggaaaagaagatgcaaaggttattgtatgccacattggtaatggtgcaagtatctccgcatctatcggtggaaaatgcgtagacacaagtatgggacttactcctttggaaggacttgttatgggaacacgtagtggagatgttgatcctgcagttcttcagttcatctgcaatcatgaagatatcagcgtagatgagatgctgaatatcctgaacaaaaagtcaggacttcttggaatcagcggtgtgtcttctgacttccgtgatgtaagacaggcagctgttgacggaaacgaaagagcacagcttgcaatggatacttacaaataccgtgttgcaaaatatatcggatcttatacagcagcaatgaacggtgtagatgcaatcacatttacagccggtgttggagagaatgctccggacctcagaaaagacatctgtgattaccttggatatcttggcgtagagctcgacgaagaaaagaatgagaatgttcacggagagacaaccgtaatttctacaccagaatcaaaagtaaaagtaattgtccttcctacaaacgaagagttagctattgctcgtgaaacagcaaaattagtttaagactaaatgactaaaagaatgtaaatttctgttgacaaaataattttacatgatataatagtctagtgtgtgaataggagacgatactatgatattaaacctatccgacgttctgtctgagcagcataaagcaatacatgaatctgttccgatcgaaatgacttgtttcaagtctgagatgggagattatgcaattacagagaagacaccacttgaattgtctgtagaatatgcaggtgaccgcaagttggaagtgactggtaaagctaagattacatcagttgcaccatgtgacagatgtctggaagatgtagaagtgaaggtgacacttgacttcaagcataagattgatacagagtcagatgcatatgatcagtcagaagatttagacgagaataactatattgacggatatagcttagatgtagaacaattggtctacaacgagttattggtagggtggccgacgaaaattctatgcagcgaagactgtaaaggtatttgcaacgtatgtggtcagaacctgaataaaggtacctgtaactgtgaagatacggggctcgaccctagaatgtcagttatccgtgatgtatttaagaattttaaggaggtgtaacctatgtcaatttgtccaaagaataaatcttctaaagcaagaagagacaaaagaagagcaaactggaaaatgagcgcaccaaacctggtaaaatgcagcaagtgtggcgaattaatgatgcctcacagagtatgcaaggcttgtggttcatacaacaaaaaagaaatcattgctcaggattaatttttgaaaaatgataaaaagagacgatcagttttggtcgtctctttttttgactgaattttgtataaaatggtgaaaaaaagataaaatgattacattttgtgttgcaacattttctgaaagtgttataattttaaccagatatagaacgtagtctataaataaactgccgatggggaaagtgaaaattcgttttaccggcaaagagatggactatgtagctaaggaggaaaacagaatgacagaagtagcaaagcgtattgaaaagcttcgcgcactgatggcagagcagaatatcgatgcatatgttgtaccgactgcagatttccatcaaagtgagtatgtaggagagcatttcaaggcaagaaagttcatcaccggattcagtggttcctacggaacagctgtaatcgcaaaagatgacgcgggtctgtggacagatggaagatatttcacacaggcactgacagagatggaaggcagtggagtacgtctgatgaagatgttcgttgatgatacaccttctacaacagaatggcttgctcagaagattccggaaggcggaaaagttgcatttgacggccgtgttctttctatgggtgaaggacaggaatatgaagaagtattgggcgcaaagaatatcacaatcgagtatgaagtagatctgatcgatcagatctgggaagaccgcccatctctttctaagaaaccttgcttctttctggaagataagtatacaggagagaatgttgcatccaagctgaaacgagttcgtaagaagatggctgaatacggagcaacagtacatctgattgcgtctctggatgataatgcatggcttctgaacttcagaggagatgatatcgactttttcccactggttctggattatgtgatcgtacgtaaagacagtgtagatctgtatattgatgacagcaaactgaatgaccgcatcagagaagaaatggcaaagaataatgtcaatattcatccatataatgacatttacgaagatgccaagaagatcggtgcagatgaggttgcactgatcgacccgatgaagatgaactatgcactgtataagagtcttccgtgtaaggtagtagaaggagctaacccaactatcctgatgaaagcgattaagaatgatgttgagattgagaacatcaaaaatgcagagctgaaagacagtatcgcactgacaaaattcatttactgggttaaaaagaactatgacaagatggagattacagagctttctgcttcagataaactgacagctctccgtgcagaacaggaaggatatatccgtgattcattcgaaccactgcaggcttttggcgagcatgctgcaatgatgcactatgcaccatccaaagagacagacgttgtattaaaagaaggcggtatgcttctgagcgatacaggcggcggatattatgaaggttctacggatatcaccagaacaacagtattgggacatatcacaccggaactgaagaaatattacacagctgtatatagagcaatgcagcacttaagcgcagcaaacttcctgtatggtaaccacggatggtctctggatgttctggcaagacagccaatctgggatatgaacaaagacttccagtgcggaaccggacatggattcggatatcttggaagtatccacgagccgccaacaggattccgctggtacatcgttccttctaagaatgaacatcatcagtttgagcctggtatggtaattacagatgagccgggaatctatgaagaaggcgatttcggtatccgtatcgagaacaacctgcttactgtaaacggtgaaaagaataaatatggacagttcatgcactttgagactctgaacttcgtaccgatcgaccttgacggtatcgatccggaagaactgacaagatcagagaaagaatggctgaatgattatcacaaagcctgctacgagaaagttggtccatatctgactgatgaagaaagagaatggctgaaagaatacacaagagctatctaatacttccaaagtacatagaaaagattgcaagtaagtaactttacttataagaaaaattaactgacatggggtgtcagaaaaatttataataaaaaaaatagtgccgcgggccagcggtctgcggcgtcttttaagaaaaggagaataggtaaaatggcaaaaattacagaaggatatatgcctttccatggctatcagacatattacagaatcgttggagaacagaaagataatggaaaagctccgttaatctgcttacatggcggacctggatctacacataactattatgaagttctggataacgttgcagatgatgatgatcgtatgatcgttatgtatgaccagttaggatgcggtaaatcttatcttgacggacatcctgagatgtggacacaggatctctggctggatgagttagatgcattaagagaacaccttggactgaaagaatgccacatcattggacagtcatggggtggaatgatgcagattgcatacgccatcgagcgtggagcagaaggtgtaaaatccttcatcatttcttccggacatccaagcagcagcctgtgggcaagagaaggtatgcgtagaattaagatgatgtctgaagaagatcaggcagcgatcaacgacgctctggagcgcaatgatttcacaggagaagcttatctgaaagctgtagataactatatggacagatactgcaattactggagagaagatcttccggagtgctgtacaagacctaagaaatctggcggagaagcttatctgtatggatggggaccaaacgaattcgttccatctggtacattgaaagacttcgagtacatcgacagacttcatgagattaaagttccatcactgatcatgagtggtatctctgatctgtgctcaccattagttgcaaagactatggcagatgaaatcccgaattctaaatggattctctgggagagagcaagacatacaacattcgtagacagacacgatgattattgcgtagagctgatcaagtggatgaacgaatacgataaataagatatagagtacgaaagtactttggtaaagatcctcgtcagttgatggggatcttttttgcgttcaaatatgtaagatgttcatagtattgtcaaattcatatggtatcctgtaaaaaaggaggtgcatgacatgtacgaacaagattatatcatgcggatgaacagagatgtgatccggacaattgccaagctcatttggggcagagacgtggaagggcctatggatattaatgcggacgaattaaaaagcgaagataaaaaattgcttatattgaatgaacaggtggacgtagagaagattatagaattagaagaaaagatacaggagcagatagtgaataataaagaacgtgcattagaacaggcacttttattttattcttatctgaacaaacaatcagatgaatttcttgcagcaaatgattttgataaagaaaagataaaagagggtctgatgtttattgcaaaacaatatgagatcgcaaatattgttaacatgttatatttttagatgtggagattgaatacatgaatttgtataacataaaggaattcaagaaaacaggatatacgtgggatattcagggaagaaaaacagcaagaagatatattgccgcatactggagtattaatgcactggcgataatttttatatgtgtggcagcttgtttaaatatcaagtttggttttttgaaaataaacggttatttttatttggtaatagctgacattatttttgcattcggattacgaatcacggcatctgtatacacaaaaaacagattaaagaaaaagtcgttagaaacacgttatgactataatttatacctgtatcatcatcacagatactggaaaaataaactaactgctaatatggtattattttccaacgcagttattgatataaagaggaagaaatatgtccgggcaaaacaagaactggatctgatgtatagtgaaaaacataagatcaatgatttaaagaaaatctattttctgaaagtgatcattgcctgttatgaacagaacgaagaggaattaaaagatgcttttgtgcgttatacaggaataaaagatacgacagtggattatccggatgcagatacgttaatgaactggattttggacaatgatatagaaaaaatgacagaaatgatagacaaaatagtcattccggtgaaaaaaagaaatcctgtatggatatgcgggcttacactgttcctgacatatagttttatctttttaggcttatgcaatgaactaaatcatgaggctaggtatgatcttagaagaattttttcttttggttcagcggtagtagttgatgccggacttacaatttttcttatctgtgtcgctgcatggatatatcgtcatcagtatatagatgacacgatggctgcaaagggccggaaggctatacgatttggtatgtgtgtaataatgacggttatggggatgaatctattaggtatacatttttttagcctatgtctgaagctggatacaaaagaagtcgtaacggagaagaaaaacggatatacatatctggatgtgtattgggataatctgagatataacagttatacagtggcataccggaccaataatccatttataatgaaaaaagtgaatgtgttgagcaatgatcaggttaaaacattgaaaaatctaaaaaagcaaaatgaatccgattccaaaagcagaactaaggaaaagcaaaacagcaagacatcggatggaataacacagagtgattccggacagaacagtatgacagaaaataatccgaatcagattcaggaatcagattcggattatttgaaagagaaggcagaaatgcaggcaatttataattatcttaatagtacaaattctttacaacaaatggaactgagctatgcaagcaatgcaaaaggcgagatatatgcaattgtcggcagtggaaccgaaacaaaagatggaaattctatagtgataaaatataacctgtattataataaagagaaaatggatgcaaataatacgaactgtgatgaatttgtaatggaaaaacagtatgtaaacggggaatatgagacagagattattgatttttatctggtgaatccggatacattggaagttacagatgagcataagacaacctggtagaagtagaagatgaataagcatcaggtcgaaccatataaaataatgataagaaaggaaagaagaaaatcatgaacagtatttttcacagaatcagtgtaagaaagtatgaggacagaccggtagaaaaaaacaaaatcatccagatattaaaagccggcatgcaggcacccagtgcatgtaatcagcagccatgggaattttatgtagtaacggataaagaaaagatagagcagctttcagagtcaacaccatattcaaagtgtgcagccggtgcaccagttatcatcgtaccagtatatcggaaagagggactgatatcacctgattatgcacagattgatctctccatcgcacaggagaatatctggcttgaaacagatgaactggggcttggcggtgtatggattgggattgcaccgataaaagaacgcatggatcatgtgcacaaattattgaatcttccggataatgtaaaagtattctcgttgtttgcattaggatatccggcagaggaaagaccacaacaggatcggtttgatgagaacaggatacattttattgaatagaaacagataggcataagaggcactcatctaagggtgtttcttatgctatttgctttattctattctacctcatcttctgaagaaagtttttcaaagcttcctgataatgcccataagattactccacatcataccccgagcaaggttccaagtaatcttttaggtgcaaatttattaatgaaaatgttatggaataacagcaaaagaatacaggaatacacacacaaacagtcatttacagaacctgccgcccgcaatttttttcgaacacagggaaatcctagagaataattagtgacttcaccacataaatgtgataaaataaatcagctggcatataagaaaaataaatgcctgatcatataatcttataagaaagagggaaagttctgaattattgcaatcgggaaaatcagaactaaaagagagatggaaaaagaaaaaagtaacagaagttccttttcagggaaaataggattcgttctgtcagcggcaggcgcatccgtgggtctgggaaatatctggagattcccatatctggcagcaaaatatggcggaggaatattcctcctgatctatattctgcttgcactgacatttggttatacgatgattgtcgcagagtcggcacttggacgtatgacacggaaaagtccggtcggagcattcaagtcgtttggaaagaaagccggctggctgtcgttcggcggctggatcaatgcggttattccggtgttgatcgtaccatattattcagttatcggcggctgggtaatcaaatacctgatcgaataccttaaggggaatagtacgaaacttgcgacagacggctatttttcagaatttatatcaaatggagcgtcgacagaaatctgctttgtaattttctgcatgattacattgatcatcatttatgcaggagttcgtaacggaattgaacgagtatctaagtttatgatgccgatcttagttatcttgtctgtaattatcgcaatctattcggtaacaagaccgggtgcaatggcaggtgtaaaatatttccttgtgccaaatccaaagaacttttcatggatgacagtggtaacggctatgggacagatgttctattctctgtcgattgctatgggtattctgattacatttggatcttatatgaaaaaagatacttcgattgaagattctacaagaaatgtagaagtatttgatactgcaattgcaatcatggcaggattgatgatcattccggcagtatttgcattctcgggtggagatccggatacacttcaggccggaccatccttaatgttcatcacaattccgaaagtctttgcaaacatgggattcggaactgcagttggaattatatttttcctgctggtattatttgcagcgatcacaagctccatcgcactgacggaaagtgccgtatctacggtggaagatgagattggctggggacgtaaaaaagcaacggtaatcatcggattgattatgatcattcttggaacactttcctgtctgggatatggtccgttagcatttgtgaagatcatcggaatgcagtttctggatttctttgatttcctgaccaattctgtaatgatgccgatcgctgcgcttatgacaagcttattcgtaacaaaggtcgtaggtatcgaccgcatggaagaggaaatccgccacggagaaagtaaattccgtagaaagaaaatctttattgtaatgattaagtatttgtgtccgatctttgcgattattattctggcaagttcggtggcgaatgcgtttgggtggattacgatgtagatggggttctatttaattcatcatggtggctgtcaccgatcggaataaaactacaaggtcccatcctgtgctgactccaaccaagagtccgtatgcacaggatgggaccttgtagttttattcctgagttttcgcatgccataataattaaatagccaaatacctctctgcacaataagccatacaggccgccccgatcgggcacactgcttcattaaactgtactttcggattatgtgcagaatatttcccacgttcatccatatatcccgcagacagatacatgaatgtcgatggtacgcgttcagcaatatttgcaaaatcttcagaagcactggcagatacacccggatatggtgtcattccagggatagtgagttctttcataaagctggcgatctgttctgtgagttccggattgcagatcagtggaggtacttcggaaatcatagtgatttcagcagttccgccgaaagtttcggcaatacggatggcggtttctttcatccggtgtacaaggagttctctggaggccttgtcattggttcgtatcgttccctcaagaacggctgtatccggaataatattggcggcggttccggcctgaaatttaccaactgtcataaggcaggctttggaaggatcaacctcacgtgcgatgatggactgcagagccagatagacatgtgccgcaatattgatcgggtcaatggaattctgaggataggcaccgtgcgaaccttttcctttgatttcaatatgaaaaccgtcaacggagtacatcatggttcctgtactgttatacatgtagattccaaccggcatctgcccgggagatacatgataggcaagagcggaatcaacttttggattttccagaattccgtgtttgatcatatttttgctgccttcgaatgtttcttctgcaggctggaacatgaatttgactgtgccttttaattcggcttcattttcttttagcatttttgcggcagtcagtaacatggccgcatgaaaatcatgtccgcaggcatgtgcttctttgccggtcgggcaggcaaatgaaagtccgctttcttccggcatcgggagcgcatccatgtcggctcgtaataataagactttgccgccgtttccaacagtagcggttacaccttcgccacatcgggaaggtgttaatccatattcggttaatttgtccatcacatatgcacaggccattggcatatgaagtcccgtttctgcattcgtgtggaagtaacgtctgtttttaactgtttcatcattgagctcaagggctctcttataataatccatttattgaatcccttcttttatatattatatatgcaattttgatgataaaaggtattatatcaaccggatcgtatattatcaaacttctgaaaaatatttttgaaaaattttataaaagtatcacagttgttcgtgatgaagtttatattggcgtttttcacaggaaaatattgatttttgcatggatgtttagtagaataaattcagtaatattaggaggaataaatatgtcagaaattacggtgatcgcattggacgctatgggcggggacaatgcaccgggtgagatggtaaaaggggcagtcgatgcccttggacgtgaacaggatataaaggtatatctgcttggcaaagaagatatagtgaatactgaattgcagaagtatacttatgataagaacagactggaagttgtgaatacaacagaagtaatagagactgccgaacctccggtaaatgcgatcagaagaaagaaagattcttctattgtagtcggaatgaagatggtaaaggaaggaaaggctgatgcatttgtatctgccggaagttccggagcaatcctggtaggcggacaggtaatcgttggaaggatcaaaggtgtagagcggccaccacttgcgtcactgatcccgacagagaagggtgtagcacttctgatcgactgtggagcgaatgtagatgctagagcctcacatctggttcagtttgccaagatgggttctatctatatggaacatgtagttggtattaagaatccgaaagttgggattgtaaatatcggagcagaagaagaaaaaggtaatgcactggtaaaggagacgtttcctcttttaaaagaagaaaaagaactgaattttatcggaagtgtagaagcaagagagattccgcatggacaggctgatgtcattgtgacagaagcattttcgggcaatgtaatccttaagctatatgaaggtgtcggggcggtactgatcagtaaggtaaaagaaggactgatgtccacactcagaagcaagatcggagcattgcttatcaaaccggcgttaaaaacaactttaaagtcatttgatgcaagtgagtatggcggtgcgccattgcttggattaaacggtctggtcgtaaagacacatggaagctcgaaagcaaaagaagtcagcaatacactgatccaatgtgtgacatttaaaaagcagaaaattaatgaaaagatcaaagaaagtattcaatcggagcaaaaatccgctgaataatatattactaactatgataagaaaaggagatttgatatggaacttgaaaaattaaaagaaatcatcgctgatgtattaaatgtagaagtgaatgatattacagaggacacaacatttgtagatgatctgggagcagactcccttgatatcttccagattattatgggaatagaagaaacatttgacattgagatcgataatgatgacgctgagcagatctctacagttggagatgctgttgagcagatcaagaatgcaacaaataataactaggcagatataaaaagaacgaaagggccctgccaggggcttttttcgttctttaggatggagtttacgatgagcaaagaccttaaagaattagaaggaaagattggttacaaatttgatgactttaccctgtttacaaaggcgatgattcatagttcttacgccaatgaaaaacatcttccgaagtatgaatgtaatgaacggctggaatttctgggggatgcagttcttgaactggtgtccagcgaattcctgtttcacaataatccgaagcttccggaaggggaacttacgaagacgagggcaagtatggtatgtgaaccggcgctggcattctgtgcaagagatctggatcttggtgaataccttctgcttggtaaaggagaagatgctaccggaggacgaaagagagaatctgtaacatcggatgcaatggaggctctgatcggagcaatttatcttgatggtggttttgctaatgcaaaagagtttatacatcgatttattttgaaagatttggagaacaagaaactcttttttgatagcaagactatcctgcaggaaatcgtgcaggcgaattttaaagaagtaatctcgtatcatctgattggtgaagagggaccggatcataataagacttttcgtgttgcggtacatatcggagaagaagaatacggagtcggagaaggccggacgaagaaagctgcagagcaggaggctgcatatatcagcattttgaaactgcatgaaaagaatataaagtaggtgtggaatgtatttaaaaagcatagaagtgcagggatttaaatcatttgccaataaaattaaattcgaattccataatggaatcaccggcattgtcggtccgaacggaagtggaaaaagtaacgtagcagatgcggtcagatgggtgcttggggaacagcgtgtgaagcagttaagaggcggcaacatgcaggatgttattttttccggtactgagaacagaaagccgcttagttatgcatcggtggcgatcactctggacaattcagaccataagcttccggttgattacgaagaagttacggtagcaagaaagctataccgttccggagaaagcgaatatctgatcaatggaagagcatgcagattaaaagatgtaaatgaacttttctatgatacaggtattggaaaagaagggtattcgattatcggacagggacagattgataagatcttaagtggtaagccggatgagaggcgggaactttttgatgaggcggcaggaattgttaaattcaaacgaagaaaaagtatgtcggttaaaaagttggaagacgaacgccagaatcttgtccgtgtcaatgatattctgtctgagttggaaaagcaggttgggccgttagaacgtcagtctgaaaaggcgagggagtatctgaaacggaaggaagaattaaaaacatacgatatcaatatgtttcttttggaaatggaacgtatccgggatcagatccggaatctggatgaaaaactgcgtattacaaaaggagaactagaagaagcaaccagaaagtatgcagatacaaagacagaatatgagtcgattgaagaacaggtggaagtgatcgatgattccattgaaaaagcgaaccgtcagttaaatgagacaaccattctgaagcaacagttagagaaccagatcgcattgttaaaagaacagatccacagtgcgcggatgaatgatgaacacttcgatcagcgtgccggtgttattgattcggagatagatgtccgtgaaggacagctgaaagaacttcacacggaaaaagattccattgaaaaacagatggaagaaaagcggtcagaagaagataagatcaaaaatgaactgacggaattgcaggagaagattgctcagattaccggatctgtcgatgaaaaaaagaatcatattatggaaatactgaataacagagcatccacgaaagctcagattcagaaattcgatacaatgatggagcagatccaggtaagaaaatcgcagattaaccgtgaaatccttgcaaatgacagtgagatcgcagaagagaatgagagcctgaataaattccaaatggaattgaaagttatttccgacaagatcatttcactgaatgacgagaataaagaatatgaacgcaggatcagggaattgcagactaagatttcgaaagaatcccagaagctgcagatcggacaatctgcttttcacagggaacagtccagactggaatcattaaagaatattacggaacggtatgacggatacggtaacagtattcgtaaagtcatggataataaggaccgggagcagggacttttgggtgtagtagcagatatcgtgaaggttgaaaaagactatgagatcgctattgagactgcacttggaggaaatatccagaatatcgtaacggaggatgaggatacagcaaaacgaatgattcatttcctgaagaagaataagtttggacgtgcaacctttctgccgttaacgtcgatccgtgcgaattccgggattaaccggccggaagtactgaaagaaacgggagttatcgggacagccaacaaattgatccaggtggagagcaaatataaaacccttgcagattatctgctgggaagaacactggtagtagatcatattgatcatgcaacaataattgcaaggaaataccaccagtctatccgtatcgtaacactggaaggcgagctgatcaatccaggtggttccatgaccggtggagcatttaaaaactcaagtaatcttctgagcagacgacgggaaatcgaagaatttgaaaagaccgtgcagaagcttaagcaggagatgacggagatggaacaacagatctccggtctgaaagaagaacgtgcagggtattatgagaagaccgatgcaatcagtacagaactgcagaaagcatatgtcgtacagaatacggcgaagatgaatgcagatcagtcatcagccaggatcagaagcttcagacagcagtttgataatctgcggaatgaagctgcgaaactcgatgcacagatcacggagatcatggacaatcaggaatctattaatattgagctggatacatccgaaagtctggagaatgatctgaatctcaccattgagaaagagcagaaagaactggaagatgttcatacaaaagagagtattaagaccagaaaatcagaacagattcatctggaatatgcaggattagagcaaaaatatacatttatcacggaaaatattacccgtatctgcgaagaggtcgataaattccggactgaattggaagagctgacaaggaataaaggcggcaattccagggaaatcaccgaaaaagaggagaagatccaggagttaaaaacaacaatcgatcattccggagatttgtttgaagagatcaaacttcagatcgaacattcaaaaagtgaacgaatggaactgaataaacgtcacaaagcgttctttgaaaaacgtgaagagatctcgaaacatatggcggatcttgataaagaagtttaccgtctggaaagccagaaagaaggctgcgaagaagcttccgagaagcagattaattatatgtgggaagaatatgaactcacactgaatcatgcaaaagagcttaggaatccgaatctgaccgatcttgcagatatgaagagacggatccaggaattaaaaagtgagatccgtgcactgggaaatgtcaatgtcaatgcgatagaagaatataaaagtgtatccgaacggtatgaatttctgaaaggacagcatgatgatctggttgaagcagccgaaacactggagcagatcatcgaggaacttgataatgccatgcgcaagcagtttaaagagcagtttgccagaattgccgcagagtttgatcaggtattcaaggagatgttcggcggtggaaaaggaacgctggaacttatggaagatgaggatattctggaagcaggtatccggattattgcccagccgccaggaaagaagctgcagaacatgatgcagttatccggaggcgaaaaggcactgacagcaatagcacttctttttgcaatccagaatctgaaaccgtcaccattctgcctgctggatgagatagaggcggcgcttgatgataacaacgtagaccgttttgcgcaatatttgcacaaattaacaaaatatacgcagttcattgtaattacacaccgacgaggaacaatgaccgcagcagacagactgtatggtattactatgcaggaaaaaggtgtctctacactggtatctgtcagcctgctggaaaatgaactggataaataggaggaaggtatgggattttttgaaaaactggttgccggtcttggcaagaccagagataatattgtatcaggaatggacagcatctttcacggattctcccgtatcgatgatgacttttacgaggaattggaggaagtactgatcatgggagaccttggtgtacaggcaacctatgatattctggatgatctgaaagcaaaggtaaaagaaaaacacatcaaagaaccgatggagtgccgggaacttctgattgaaagtatcaaagaacagatggatatcggggaaacggcatatgaatttgaaaaccatacatccgtagtgatggtgatcggtgtcaatggtgtgggaaagactacaacgatcggaaagctggccggaaaactccgcgcagaggataagaaagtggtaattgcagcggctgatacattccgtgctgcagcaggagaacagttaaaagaatgggcgaaccgttcgcaggctgagctgatcggcggacaggaaggctctgacccggcatcggtagtgtttgatgctgttgcggcagcaaaagcacggcacgcagatgtattaatgatagatacagccggtcgtctgcataataaaaagaatctgatggaagaactcagaaagatgaataagatcatcgaccgggaatttcctgaggcatacagagagacgctggtggttctggatgcaacaacagggcagaatgccctgcagcaggcaaaagaattcaacgatgtggcagaaattacaggaattgttctgacaaagatggacggaaccgcaaaaggcggtatcgcagttgcaatccatgcagaacttggcgttccggtaaaatatatcggtgtaggagagaccattgatgatctgcagaaatttgatgcggatgatttcgtgaatgcgttattcgaaagaccaaaagatgatgagacttcagaagaggtttcagaaaacaaataagaggaagagaggaaatacgagatgttaacattagaaaaattcaagcaggcgagtgaaatcgtaaaagaagtaacccttccaaccaagctggtatacagtgaatatttaagcaaccagacaggtgcagaagtatatctgaaaccagaaaatatgcagtacacgggtgcttacaaagtacgtggcgcatattataaaatcagcacaatgagcgaagaaaacagaaagaaaggtcttgttacagcatcggccggtaaccatgcacagggcgtagcatatgcagcaaaaaaatttggctgcaaagcaacggtcgttatgccgacagttaccccactgatcaaagttaaccgtaccaagagttatggtgcagaagttgtattacacggggatgtctatgatgatgcctgcgcatatgcgatgaaattagcagaagaaaacggatatacgtttgtccatccgttcgatgatctggatgtcgcaaccggacagggcagtatcgctatggaaatctttgatgaacttccggatgtagattatatcctcgcaccgatcggtggtggcggactgattacaggtgtatctacacttacaaaacttctgaatccaaatgtaaaagtaatcggtgtagaaccggcagctgctgcaagtatgacagaagcattaaaggaaagacatcctgtaacactttccagtgcaaacaccatcgcagatggtactgctgtgaaacgtgtaggagagaagatattcccatacgcagagaaaaatattgatgaagtgatcaccgttgcagatgatgatttgattggggcattcctcgatgtagtagaaaatcataagatgatagtagaaaattccggacttctgacggtggcagccctcagacagcttgatctgaaaggaaagaaagtcgtatctatcttaagcggcggaaatatggatgtgatcacaatgtcgtcaatcgtacagcatggattgatacagcgagacagaatcttctctgtatcggtactgcttcctgacaaaccaggtgaactggtacgtgttgcatctacgattgccaaagcaaacggtaatgtaatcaaactggaacacaaccagtttgtaagtaccaaccgaaacgcagcagtagaacttcgaatcacactggaagccttcggaaccgaacacaagcaccagattatgaaagcgttagaagacgaaggcttaagtcctagagaagtcaatgccaagctttattaatatgataccagagaactttttcagcgactattcaaaaaatgattatggaaatcccataatcattttttttgaataaatatccataataatacttgacaacacatgtatcattgtatacaattatacatgttgaatttagtactttactacgaaaaattatttttagaaagcaggcgatgaaagaatggaaaacaggaaagtatacctggataatcatacaaatttattgcaactggaagaacacatgtacccgttggtagatgtaaagacgccgaatgtgtttcgtaatctgttccattatgatgagattccgaaaatcgcattcaatgaccgaattgttccgcattgtatgccggatgaaatctggattacagatacaacattccgggatggtcaacagtcacgtgccccatacagtacggagcagatcgtaacattatatgattatttccatcgtctgggtggtccaaaaggaaagatcagacagtgcgaattctttctttacagtaaaaaagacagagatgctgtatacaaatgtatggaaagagattataaatttccggaagtaacaagttggatccgcgcaagcaagaaagatttccaactggtaaaagagattggaatgaaagaaacaggtattctggtgagctgttcggactatcatattttctataaattaaaaatgaccagacgtgaggcaatggagcattatctgtctattgtaagggaatgccttgagacaggaattagtccgagatgtcatctggaagatatcacccgttccgacatctacggattcgtgatcccgttctgcctggaactgatgaaactgatggatgagtataagattccggttaagatacgtgcctgtgatacgatgggatatggagtaaattatccgggagcagtaattccaagatctattccgggaattatctatggtctgcgtgtacatgcaggtgttccgagtgaactgatcgaattccacggacacaatgatttctacaaagcagtcagcaactcttcaaccgcatggttatatggtgcttgtggcgtaaactgttcgctttttggaatcggggaacgtaccggcaatacaccactggaagcgatggtattcgaatatgcacagcttcgcggtacactggatggcatggatacaacagtcatcacagagatggcagattattatgaaaaagagattggttaccgggttccttccaggacaccattcgttggcaagaactttaatgtgaccagagccggaatccatgcagatggactcttgaaaaacgaagagatttataatgtattcgataccggtaaattcctgaaccgtccgccgcttgtggcaatttccaatacttcgggacttgcaggtattgcccactggatcaatacatattttaagcttccggatgataagaaagtggataagaattcagaactggtaaacgcagtaaaagactgggtagatgaacagtacgaagaaggacgtgtaaccgttcttacagatgatgagctgatcgcagttattgatcagaactgcaaaagacagggtatagatttgatttaattggggtgtttttatggaagaatatcaggacagatccttacgaggaagagtgttccggcatctgcgggaagatattctgaatggggtatataaagatcatgaagaattaagggaagtaacaatcggtgaagaactgggggtaagcagaacaccggtaagagaagccttaagacaattggagttagaaggactggttacgatcattccgaataaaggtgcgtatgtgacagccattaccagaaaagatgtgaaagatatctataagatacgttcgcaactggaagggctgtgtgccaactgggcaacgaaatatattacggatgcgcagattgaagaactggaagaagtgattcttctgtcagaatttcatttacataagaaaggatccggacagattgaacagatgtcagaaatggatggtaagtttcataagatattgtatgaggcatccaacagcaggatcctggaacatgtattgacagattttcacaagtatgtacagcttgcaaggacgatgtcgattgaagcaccggagcgtgccgaaaagtcaatagaagaacaccgagaaatactggaagcgatcaaggcaaaagatgcggcaaaagcagaacagcttgcaaacgaacatatattacatgtgatggaaaatctgcatctggaagaataatgaaagatgccgcgaacagatagaaaggagacaaacatcatggcaaaaattaaaatgacaacaccaatcgtagagatggacggggacgaaatgacaagaatcctctggaagatgatcaaagaagaccttctggagccatatattgaactgaacacagaatattatgatctgggtctggagcacagaaatgagacgaatgatcaggtgactatcgatgcagccaatgcgaccaagaaatataaagttgcagtaaaatgtgcaacaatcacaccgaatgcggcacgtatgaaagagtatgatctgaaagaaatgtggaagagcccgaacggaacgatccgtgcaatactggacggaacagtattccgtgcaccgatcgttgtaaaaggaattgagccatgtgtaaagaactggaaaaaaccaatcacgattgcaagacatgcatatggcgatgtatataaaaatacagagatgaagattcccggacctggaaaagtagaactggtatacacggcagaagacggcacagagaccagagaactggtacacaattatgccggaccgggtgttgcacagggaatgcataacttatgcggatctattgaaagctttgcgagaagctgctttaattatgcattggatacaaagcaggatctgtggttcgcaacaaaagatacgatctctaagaagtatgaccatacattcaaagatattttccaggaaatctttgacaaagattatgccgagaagttcaaagaagccggaattacatatttctatactttgatcgatgatgcggttgcaagagttatgaaatcagaaggcggatatatctgggcatgtaagaactatgacggagatgtaatgagtgatatggtttcttccgcatttggttctcttgcaatgatgacatctgttctggtatcaccggacggaaattatgaatatgaggcagctcatggaacggtacaacgtcattattacaagcatctgaaaggggaagagacttctacaaactctgtagctacaatttttgcatggacaggtgctctcagaaaacgtggtgagatggatggaaattccgaattgacagcgttcgcagataagcttgaaaaagcaaccatcgataccattgaagaaggcaagatgacaaaagatctggcattgatcacgacactgggaaatccaactgtattgaacagcgagggatttattaaggcaattgccgagaaattaaagtagataatatatgacaaaaacaccatacaatgtgaaaattcccgaatgaatttgacggatcacagtgtatggtgtttttatgtatgaatgaacagcgtataaattaagcgtcttccgctaattcctcccatttcatatataattcttctaattcttccgctatggcggctttttcttttgccaattcctggcattttacagagttggtgaagatttcttcctgaaccatcagggcatcaatctcaacgtcgcggtcttccagttcaccgatacgctcttccgtctttttaagctcattctgacgtttgcggagtcttgcctgggcttccttttgctcctgccagctgagttttgactcggatacattcttgtctgtattgttatctgaaacagatgaagatgtagaagctgctccggcatatgcggtagtgagttcttcttttttctccagataatagtcataatttccgatataatttacaaatgtatgattgacaagatctagaatccgtgaagcggtctgattgatgaaataacggtcatgagagacataaagtacggtgccggcataatcattcaaagcattctcaaggatttctttagatgcgatgtccaaatggttggtcggctcgtcgaggatcaggaaatttgcttcagagagcatcagtttcgcaagagatacacgtccgcgttccccaccgctcaaagaactgatctgtttgaagacatcatcaccggtaaaaagaaatgctgcaagcacattccggatttccgtattcgtaagagtcggataatcatcggaaatctcgtcaaaaattgttttctccatatgaaggacatgatgttcctgatcgtagtagccgatcttaacattggagccaagtgtataagtaccggaatcggcagataccacacggtttaatatcttaagaagcgtagtctttccagttccgttatcaccgattactgcaacatgttcacctcgtttgatctcaagattgacgtctgtaaaaagctcctgtccggggaaagatttgcttaaatgttcaacagtcaggacatcattgccgcttacacaggatggttccagtttcagatgtatatctgtattaacttctatcggtttttcgatggtctgcatcttttccaacatcttttcacggctttcggcacgtttgatggatttttcacggttgaaagaacgaagcttttcgataactgcctcctgatgcttgatttcctgctgctggttaagatactccttcaggcgtatgtcgcgaagctgctgcttctttgctgcatagtcactgtagtttcccatataagtacgaagttctccaagctcgatttcaagaactttcgtgacaactttgttcaaaaaataacggtcgtgagacacgatcagcacagctccctggtagtttagaagataggtttcaagccatgcaatggaattcagatccagatggttggttggctcatcaagaagcaaaatgtctggtttcgttaacagaagcttgccaagagatacacgggttttctgtcctccggagagagtgtcgaccggtttggtgaaatcattttccgtaaatccaagtccttttaacacaccggtaatctcactttcgcaagaatagccattctcacgttcaaaagtggccataaggcgattgtaagtttccagacggtcgttcagagcgtcaccggagagatgcttaagttccatctcgatctcgcggatacggcgctccatagcgattatatcggcctttgcggtgcggacttcttcgtagatcgtattaccgctttgcatctcttgatgctgggcaagatagccaagcgtcttaccttttgtcaggatgacgttgccgtcatccggggctgattcgcctacaatcattttgagcagagtagacttaccggcaccgttcggtccgacaagagctgctttttcgtgatcttctatatggaaggatccatctctgacgatgaggtgttcaccgaaagatttctggatcccgtgacatgctaatatcatatatttcctcctgcgttgtggataattgatacattcgtattcgtaaaatgcatttgcacatgctattttattataacggaaattgtataaaattcaacaatagtttgacaataatctttcaattttatataattatttcagactatgattggaagggtgaatatagtggaagaaagagagatttctcgtgcagtcattcgtagattgccgaggtattacagatatttgggtgaactgctggaaaatggtgtagagcgtatatcttcgaacgatctgagtaagcgtatgaaggtaactgcatcacagatccgtcaggatctgaataactttggcggattcggccagcagggatatggttataacgtaaagtatttatacacagagatcggaaaaattttaggattggaagaagatcataatatcattatcatcggtgccggtaatcttggacaggcactggcaaattatgcggcttttgagaaccgtggatttatcctgaaaggaatctttgatgtgaatccaagacttcagggagtctctatccgaggcgtaccgatccgcatgatggatgacctgaaagcatttgtacagaacaataatattgatattgcagtgctgacgattccaaaagagaaagcaattgaagtggcgaatatgctggttgataacggagtgcgtgcgatttggaactttgcgcacacagatctgaatcttccggataatattgttgtcgagaatgtacatctgtcagaaagcctgatgcagctgtcatacaatatcagtcgttacaaagaggatcataagtaaattatcataaaagaaaaaggcgtgtaggagtagtccggaagatggacatatttttacacgttcttttgttgcggtaagtataaagcaggacttgatgggagatgattggatgcagctttgggtgaatgcagcacagatgaaagcagcagatcagtatacaattcaaaaattaggggttccttccctggaattgatggaacatgcggcgcaggcgtgtgtacaggtattagaagatgaaaaggttgatctttcgcatgtctgcgttgtctgtggttcgggtaataatggaggggacggtttcgcaattgcccgcattttacaaaataacagatactccgtagagacattttgtgtgggaaacccggagcattataccgaggaaacacaggaacagatgcatcgcttacaggaatgcggcggaaagattacttatggaatgccgcaggaagactcctatagtgtgatcatagatgctgtctttggagtgggtttgagccgtaaagtagagggcagatatcgtcaggtgatcgaacagatgaaccggatgaggggaacaaaatttgcggtagatatcccgtccggactttctgccacaacaggctgtattctgggctgtgctttcaaagcggactatacagtgacattccagttaaaaaagattggtctggaactgtcacagggcagaattatggctggcagggttatcgtgccggatatcggcatttctacagattctatctgtgaggatcaggaaatagtccggacagccggaaaaaatatctaccggaagatgctgccggacagaccggaagattcaaataaaggcacgtatggaagactcctcgtgatagccggaagcaaaggaatggccggggccgcttatctgaatgcgcatgccgcttacatgacaggggcagggctggtgagagtatacacttcctcggataatcgggagatcttacagacactccttccggaagcaattatcacaacatatgaggaatataataaagaagaactgttatcacttcttacatgggcagatggtgtttgtatcggttcgggccttggaatgagcagactttccgaaaaaatattaaaaaccgtgattgaatatgtaaaagtaccgtgtctgatcgatgcagacggactgaatcttcttgcagaaaataaaaattatctgaatcagatggccgagcgcagatttgtgatcacaccgcatatgaaagaaatgtcaagacttacaggtactcctgtagaggaactgaaagcagacaggatacagatcctgaaagattttatttcaagataccggattacctgtgtactgaaagattcaagaactctggtcgcaagcgaagagaaaggtatacgtatgaaccttaccggaaacagtgcgatggcaaaagccggatcgggagatgttctcgccggcgtgatctccggatggatggtgcagggaaaagaagcggaagatgctgcagaattaggcacatatatacatggattgtccggtgaccttgcaaaatttgaaaaaggcgtatatagtgtaatggcgagagatttgatagaatatatcagtaaagcattaatgaaactggaggaagaataacagtgaagcaatatacaagagttttagccagagtcaatttagatgcggttgaatataatatagaaatgatgaaaaaaaatattcataaaaatacccagatgatggcagtcatcaaaatggacggttatgggcacggggctgtccagatcgcaaaacttttggagccgatggattacatctggggatatgccgttgccacattggacgaggcgatactgatcaaggatgcatgtctgaaaaaaccggtactggtactgggatgcattttccctgatcagtgggatgtaatgatccgtaacgagatacgtatgaccgtttacagctatgagatggcaaaagaagtatctgagcttgccgaagctatgggatgtaacgtctatgtccatattaagcttgatacaggaatggcaagacttggtttccagattacgaaggaaaatgcagatgagatcgccagaatcagcaagctgccgaatctggtaatggaaggtatgttcacgcattttgccaaatccgatgaagaagataagacatttacaaaagaacagctggagaaatacctctggatgaaagagaaattgaaaaagcgtaacgttacattcacgtattatcattgttccaacagtgccggcatcattgatctggaagaagccaatatggatattgtgcgtgcgggaattacaacatatggaatgtatccgtccgatgaggtggaaaaagataaagtaccattaaaacctgcaatggaactgatcagccatgttgcacatgtaaaatggctgacggaaggaaagccggtaagttatggaggaacttatatcacaacacgtccgacaaaggtggcgacgatcccggtcggatacggagacgggtatccaagaagtctgtccaataaaggctacgtcctgatccacggacaaaaagcaccgatcatcggtcgtgtatgcatggatcagttcatggttgatgtaacggcaattgaagatgtagaattcggagataaggttgtcatcttcggacgtgatggaaaagagttcctttctgttgataaactgggagaactttccggtagattcaattatgaatttgtgtgtgtgttaaataaacgtattccgagagaatacatccggcatggagaagtcgtagaacaggtcgacagtttttaaatcgccgtgtgttcttgaaattttgcagaatacatccgagaaaaagggaaatacttagtatatcttaagaatcggagtgtgaagcaaggtgcaggtgaaacgaggagatatttattatgcggatttaagtccggtagtcggatcggaacagggtggaattcgtccagtcctgatcatacagaatgatgttggcaacaggcatagtccgaccgtcatctgtgcggcgatcacctcaaggatgaacaaagcaaaattaccgacacatgtggaaattgacgcaagaaggtatcatattgtcagaaattccgtggttttactggaacagatccgtacgatcgataagcagagacttaaggatctggtatgtcatctggacgaagagataatgaacaaggttgatgaagcaattcgaatcagtttcgagcttcatacatagagaaggagttaaggataattaattatggaagagggaagtttattccaacgaatgaaacagatatttcacgaagatgaaatggacgaagagatgcagaaagaagcggcaggtctgatccgcaatattttccgttatatggataaggatgcaaaggatattatgacccaccgaaaaaatattgtagcaatcgatggagactggtcactggaagaggctttgcaattcatgctggatgaacgcttttcaagatttccggtctatcaggaagatatcgatgagatcatcgggatcattcatctgagagatgcaacgtccggctatctggacaagtcaaaacggcaatgtccggtaaaaaatctggaggaatacctccgtccggttacatatattcctgaaacaaagagcattgatactcttttcaaagaaatgcaggctgctaaaaatcatatggtcgttgtgctggacgaatacggacagacttccggccttgtcgcaatggaagatatcctggaagagatcgtcggaaatattttggatgaatatgatgaagaagacgaaatgatcaaaaaacagaatgacggaagtatgattgtcaatggtctgactgaactggaggatctggaagatctgattccggtaacatttgacaaagaagattatgagacactgaatggatttctgatcgataaactggaacacatccccggagaagacgaaacctgtgttgttgactatgacggctatcgtttcacggtattacagatcgataataatataattcagacagttaagattgaaaaagttttcgaagcgtgatagaatagacaacgtgtgtaataatacaattttaaaaaaagataaaaacaaatagataaagagaggtaaaagacatgtcaggacattcaaaatttgccaatattaagcataagaaagaaaaaaatgatgctgcaaaaggaaagatttttacaaagatcggtaaagagattgcagtagctgtaaaagaaggcggaagttctgatccttctaacaacagcagattacgtgacgtaattgcaaaagcaaaatctaataacatgccgaatgataccatcgaaagaaatatcaaacgtgcatccggagatatgagtgcggcaaactatgagcacattacatacgaaggctatggaccgaacggtacagctatcatcgtagagactcttacagataacaagaaccgtacagcatctaacgtaaagaacgcatttacaaagggaaacggtaatgtaggaacacctggatgtgtatcattcatgttcgataagaaaggtcagatcgtaatcgataaagaagaatacgaaggcgatgccgatgagctgatgatgcaggtactcgatgcaggagccgaagattttgtagaagaggaagacagctttgaagtattgactgatccggacgattttagtgcagtccgtcttgcaatggaagaagcaggaattcctatggcatctgctgaagtaacaatgattcctcagacatatgtagaactgacagacgcaaaagatatcgccaatattcagaaaactctggatatgctggatgatgacgatgacgttcaggatgtatatcataactgggatgaataaaaagaatccgatacctccatactaagaaaaaagtatggaggtattttttatgagtgaagagaaaaaggaaaaagaaaaaagtgcggaaccgactgaagaactgaaagaaacaggaagcgccaatcttgagaacagcagggacagccaccggatcaaattacttactattgtaggagagattgaaggccatgaagcagtatcgggaaacaccaaggcaaccaaatacgagcacttacttcctttgcttgcggaagtcgaagacagcaatgagatcgacggattactaattcttctgaatacacttggcggcgatgtggaagcaggactctccattgcagaaatgatcgcctcactcagtaaaccgtctgtgtcactggttcttggaggaagtcattccatcggaggcccgcttgccgtatctgcggactattcctttattgtgccaagcgggacaatgatcattcatccggtgcgctcgaacgggatgtttatcggtgtgcagcaaagcctggataatatgctgagaacacaggacaggatcaccagattcctggcaaatcactcgtctatgacacaggagcggatcgagaccctgatgttaaatccgacagaactggtaaaagatgtcgggacattgctggaaggaaaagatgcggtacacgaaggactcatcaatgaagtcggcggattaaaagacgcattgaataaattgcacgaaatgatcaatgaaagaaataaaaaaaagaacgaaaatgtgtaatgacatcaaaacccctaaatgctataattataattagtattgccatcataagggggagttgtaatggcagcaaagtctaccaaaagtaaaacaactggaaaaaagacgaatacgacagcaaaaaagccgtcttcgaataaaaaaacaacaagaaaagcaacgaaaaaaacaaccgggaaaagaaaaactgccggccggaaatcaaccggaaacggtaatagttttctgatagatgagattctgatctggacaactcttgcagtcagcattattcttctgatcagtaattttggcattgcaggattcttaggagatgagatatctggatttttatggaatgtctttggtgttgcagcctatgtgatcccttttatcctgttcggacttgtatcatttctgatatcgaataaagacaaccgcaatgcatatgtcaagagtctgatcggcgtgatccttctgatccttgcagaagtattgttacaccttatcgatgacatgggcggcaagatcggaaaatctgtagcatctgttctgacacctgcaatcggtgtggcaggaacttatgttattacgatcatctttatgattatttgtctcgtcattatcaccggaaagtcagcattaagaggtgtaaaggccggcagtgataaggcatatgcgagagcaagagaagatgccagacggcacaaagaacttgcagaagaacgaaaacgcgaacgcatggaacagcggacgcaacgtgaaagagaacgggcagaagcggaagcttccggcacggaaaaacgaagagacaaacatgtagaaggggtttcctttgatacctctattgcgaagaaatcaccggaagtaagagaacttccgatcgatccaaagacagcgaaaggaccggaaaaaccggaatttgtcattcaccgtgcggatccggaaccggaagcatctgatacggcagatacaggaacggaacctgttaaaaacgctgcagaatctgcagcaggtacagcaccggaagaaaaaccaacgcggcggaaaaatcctaagatgggtgctgcaggaatggcagatgaagttgcggatgttgcagccagtgttgcagccgattctacaaaaccgaaaaaggcatacaaatgcccgccgttatcactgcttcagcacggaaaacgcggcggcggtgaatcagatgcacatttgcgtgaaacagctatgaagttacagcagacactggaaaactttggtgtaaatgtaacgattacgaatgtaagctgtggtccgtctgtcaccagatatgaattacagccggaaatgggtgttaaggtcagcaagatcgtcggacttgccgatgatatcaagctgaatcttgcagccgcagatatccgtattgaggctccgatccccggaaaagcagcagtaggaatcgaagtcccgaataaagagaacagcgcagttatgctgcgtgaccttctggaatcaccggaattccagaacagcccttccaagatatcatttgccgtcggtaaagatatcggaggaaagacagtcgttgcggatattgcaaagatgccgcatgtcctgatcgccggtgcgaccggttccggaaaatccgtatgtatcaacaccctgatcatgagtgtgttatacaaagcggatcccgatgaagtaaaactgatcatgatcgatccgaaggtcgtagagctgagcgtctataacggcattccacatctgctgattccggttgtcaccgacccgaaaaaagcggcaggtgcactgaactgggcagtgggagagatgtccagacgttatcaggcatttgccaaatataacgtccgcgatatgaagggatataatgagaagatcaaaagcctcggcgtgcagacagaagagggagaaaagctggatccgatgccgcagatcattatcatcgttgacgagcttgccgatctgatgatggttgctccgggagatgtggaagaagccatctgccgtctggcacagcttgccagagcagccggaatccatctggtgctcgcaacacagagaccatctgtgaatgtcatcaccggattgatcaaagcaaatatgccttccagaatcgcattttccgtatcatcgggagtcgattccagaacgatcattgatatgaacggggcagaaaagcttctcggaaaaggtgatatgctgttctatccatccggatatcagaaaccggccagggtgcagggttcctttgtgacggataaggaagtacagcaggttgtggaatatctgtgtgaacacaacggagatgttacatataatcaggaaatagagactcacatgaatacggttccgaccggcaatccacttggcggagcaggcggaaatgatgataatgaaaatgatgcatattttgcagatgcaggaagactgattatcgaaaaagaaaaagcatccatcggaatgttacaacgggcttttaagataggatttaaccgtgcggcaagaattatggatcagttatgtgaggcaggagctgtcggaccggaagaggggacaaaacctcggaaagttctgatgtcttctgaagaatttgaacaatatttgaatgagaaaaatggataaaagatagtattcacagtaggaggatggcataagatgagatgtaggtattgtggtcagagaatacctgaaggggaattgtattgcagacattgcggaaaagaggtccgcattgttccggactacaacccattagatgatatgcttacagcacagattaaaggtgcaatagatggtgatgaagatatatacaatgactcatatacgacacgttcaacccgaaatagaaataatagaaatgcgggaagaactgcaggagcagcaagaaatgcttccggccgcaatcggaacaccagccatagtggcggccggcagatgagcgaagaagaacgcaggcgtagaaaccgtgaacgtgcaagacagaaagcaagacgtaagaaaaagaaaaaacgcgctttattacttgccctgtttttgcttctgatcatagctgtggtcggcgtatttacttacctgacatcgtatatcggtgcagtgaacaaaggaaatcgggcgcttggccggaatgactatacgactgccgaggacagtttccgcaacgcactggcaaaagatgataccagaccggaagcctataccggcctttccaaggtatatcaggcacaggacaatgcagataaagcagaacgtttatttacatctgcgctgaaaaagcagggggagaatatagaattataccgtgcatgtatcaaattctatattcgttctgatcagaaagagaagattccggaacttctggatgaagctgattcttcgatatcagacgcacttccggaatatatagtaaaaactccgaaattcagtctggatgacggagaagattatgatgatgtccagcagttaaagctgacggcagcatccggatgtaaaatttattacacaaagaataagaaaaaaccaacaacaggaagccgcaagtataccggaccgatccagattgaagaaggtgacacaactatctatgcaattgcggtaaataaagccggcattccaagtctccctgtaaggaaatcatataccgtagaactcccaattgaggatgcaccggcagtatctccgtcaaccggacagtacagcagtgcccagaagattgagattaaagtaccggatggatatacggcatattatacaaccgacaagtcagaaccgacaacttcatccacgaaatacaccggaccggtagagatgccggaaggtgagactatctttaaggcagtgcttgtcaatgccaagggaagagtcagtggaattacgaccagaaattatgtactgaattagtgtcatacagaaagatgacaagagaggcatatatatggaacctggattagttttcacattatgcggggtgggaatttgttttctgataccggcctttatcttaggatttattaacaggagtaaaacaacgagatgcacagttacaacagttgcaacagtgaaggatattttggctaaaaattccggagacagtctgagtttctatccattatacgagtacgaagttaacaatgtcctatatacgaatactggtgcatatctatcacatcatgtcccacagaagggggcaaaaatcgagatacgatataatccagacaatccaaagaagtcgtatattccgggctacgataccaaagtatataagttattaagcattatattcagtgtgattggtatgattccaatacttgtttgtgccatcatattctttgcaattaattaagttattacagtcggttgatggctagagaatgcagactctcaaaagaaaatgccagaggctctgttttatacagggtctttctttttgaccaaattgcatgaaagcaattcgagaggttttgcccagcaggaaaagagagaaactgagcataatctttgataaaaaagtcaggttgattatatttaatcttcctgacttttctacataattagctaatattttctatatatcattaaaagcatactctcgtggcagattcctctttgcaccgataatgtacagaattgccggcatataacaggaaaaaaagataataacctgcataagaagcggaagcttataattaaaatgtcctacagacgctccagcattaaaaatcatataaagagtagccacgatatcaaagataactgccgttaccaacaaaatctttccattattaacaagctgtgcagacttttcggttgtgccacaatcgcgttcggcgatatttccaaatgataaagatagccaaaagaaagtaagaccaattgccgcaacaaataatacaagtaatccggtttgtgcaagttcggacggaattataattgtataaaataatgcaagtaataggattagtgaaaaaagtgctgttccaagaattcctgttaattgataataaattccggcaccttttaacagatagcgaccacccggagccttgctgccaccgatagagtaaagtaattcatcacaaaattcagttggggtcatgtccaaaacatcttcaaaatcttctccacgtttttcagcttcaagagccattccggtaagatcccgttcaagttgcttaatttcagaatctgataaaggaaatgtacgaatatggcgtatcatttgccgtatgattctttgatcttttttattcaacatgattttatacctccgtatcaaatatctggtttacagattgggatatctgcttccagtttgttttaaattcgttcaaatattctactccatctggtgtaatggaataatatttcctgcttggacccagtggagaggggcgcatttcagaagtaataattcctttcttttcaagacgaaccaataatggataaatggttccttcttttatatctttaaatccataacccagaagagttgtaacaatttcataaccataagatgtattttgggataatatttttaaaatacatccttctaatgttccacgcattaattgagatttatcatacattgcatcacctgatattttctaatctatttatcaatattataacatagccagaaaacatgacaatagataagtaatcgaattgacaataactactatgtggtgtaaagtagaactatgctattatgtggagcaaagtagctagctgcagattacaaaatggagaggggaatgtagatgttaacaaaaataatctataaaaattttcgaagtaatttaaagaattatattttgtttttcttgagtaatattgttgcaattatggagctgtttgtatttcgtggattaaaagagattgtattacaaattgtaaaagataccgaaacagcatttctttttagaattgattttactgtggctttaggaatgatttctgttattactataatgttgatggcgtatgctatgatttattatttaaaatcaagaataagagattatggattatttattatgatgggaatgcacaaacgaatggtatttagtttgatgttgatagaatatgttcttggctgggtattctcatcaatactaggacttattcttggaactggtatattgtatggcattcagtttttattacacaaaattgcacctttatattttgtacgaatagtaacggcaaatttgaatatatatgtgtattcaataaaatttagtatcggaattatgatttttacgttttttgctgtcatagtatggattgaaaatcataatctgagttcactgatacaagctgaagaaaagattcagaaatgtccgcaaaaaggatattggacaattgcagttattataggaattatattgagtgtaattgcctggtttatgtttccaagctatgaagaagtgcattatgatgcatattttatatggataattggtggatttttaattttaacttttggcatgggtgtattactggaagaaataaaaaaacacgaacaatttttttacttgaaaaatgtattacaaataaatcagtttagcagtaaatatcaaaataacctaatgttgttattaatgttttttgttattcatttttttgcacttacatatataagcacagaaatttcttcattattaccaatagaacactataaagtaaaaaactatccatatgatatgttgtggatggcagacaccagtgaacagaagtatatagattctttggtaaataaaatgaaaataacagaaattccaatgatgagggttacttccgttagtactgatcagcaaatcggtatttcagaaagttattacaaaaaattgactggaaagacattgcatttaagaaatcaagaaatagtagtagcaatgcaagatcaaaatcatcctaatagaaccgtaaaggatcgaacatttcaagaaaattatagaattatgtatacaggaagatattcagatgataaaagtgaagaactccattcaattgtagtaaaagggaaaagacatgaaaattccgctcaatccaaacgccatctatataaaatcaagaaaatgtatacagaaaatgtgattggacaatatacaacaaacagatggtcagaatccttgattatattctctgataaatattttgagaaagaatataaaagaatagaacagacaaaaaatgaaccgtctaaattgattttaattaaatttgatcaggaaaataaacgtgatctctggaaagaaataagaacttattccacaaaacatggaacaaaaattattaatgatggaaatgaacaaaacattatatattacacagaatcttttgtaaaaacacagcaaacattattaatgtttcgtttattaagcaaggtgtttattttaacagcattacttttagattcgatttttattatggaaataaaggttgaatcggaaattccatcctataaaaagaaacaggaatttttacgttgtatgggaatgcgaaaaaaagaacgtaaagctctttatctcttggaaatgcaaagtgtcggaatgatttcattagcagccggtatttttatgtccgtcatacattttattgcatgtttattacgaatggaaaaagcaggggaagttaataaatggaattttacaaagtattggctggttgcctgcttaggatatattgcattagagtggcttgtgcaaagaggttttgcactatatattacacataaaattgaaggagaattaaaagatgagaacaaatgtattagaagttgaaaatttaataagaaattatagaaaatccgtaataaaagaaagtgaagaagacgtaaaagtgttaaaaggaatcagttttcaagttacagaaggtgaattcgttggaatcatggggaaatccggatgtggtaagacaactttgcttaaaacactcggaatgattgataaaccgacggatggaacgattaaatttatggaagaagataccagtgaactatacggggataaacttgcggatatccggaacagtaagataggatttatttttcaggatttttatctgatggacagcctttcagttgaagagaatatcatgctgccgatgatcataagcaaacagaatattaataagatgattgtagaagcaaagaaatatgcagaacaatttcagatagaacatctgttaaagaagaacccctatgaattatccggtggtgaaaagcagagagttgccatatgtcgtgctttgatcaacaatccggatctgatccttgcagatgagccgaccggaaatttggactcaaagtcaggaaaaattgtaattgatgcattgaataagatttcatcggaatataagaagacgattgtcatggtaacacatgatccgcagatggcaagttattgtgaccggattattctgttgaaggatggaaagattttggaagaattaaagaagggtagtaacagagaaacattttatcaaacaatcctttccaaaatggcggaattataaaaagaccaatgccagtatcagctatatttgaattcaagattattgtaaggggtgggaaggtatatgctgcataaaataatttacaaaaattttaaaagcaatatacggaaatatattttattttttgtcagtaacattatagccgtagcagaattatttatcttttggggattgaatgatgttgtagtgcgggcagttacagaaccttcgattatgatgggaataaaaagtgattttatgatagcggttggattaataactgttgttacaatacttttgatggtattttctatgcgctattatattaaactccgggcaaaagattatggaacttttattatgcttgggatgaaaaagaagatgtcttatatgcttctttttgcggaatatattataggatgtataggttcacttttaattggtattttgtcaggaaatctgctcctatatggaattttatattgcttaaatcaatacaatcctcagattattacattacaaaaagtggatccggtcgtatataaaaatacaattcttttgtgtctgggagttatgcttggaatctttataatcctcctggtgtggatggacggaagaaatttaagctctttaatgatgaaagaggaaataaaggaaaaacgtcccgtcagttcaaaatggctgttgtttacagtgttagggattgtatttataatacttgcaattaaacaatataagccaggaacatggggatattattttgcacatatatattttctgataggcggaattcttattatcactttcagtggtgcatttattcttgaacaggcgaaaaaagaacctttttactttcggtatgcattgaaaatcaatcaacttgatagtaaatatcaaagtaatatattaattattctgatgttatttgtaatacatttttttgctctttcttatatcggtacacaaatagtagagattctgcctcttgacaagacaagtagtaattatccttatgatataatctggatggcacgccagaacgatgaaaaatacagtgaaaaaatagccgaaaaatataatgggacagttaaacatattccgatgattcgggcaacaatgttttattcacaggaagaaattggaatatccgaatccacatataaagaactaacagggaaggcttatggtttgtctgggaaagaaattgttataggaattgaggaccagaattatcaaagggaagaaaaagtaactgataaggttctttatgatttatttggatggctgtatattggtaaatttaatccgaataaaaaggaatttgaatcttccaatattttaaaagatgcgaattatcagtataggataaaagaaattcatacacaaaacgtatttggaaaattcgtaccagaagatgccggtgaagggtgtgaagatacagttatattttcggatgaatattttgataaacaatggaaaaaacaggcagcagatgatgaagaagtttcaatgttagaagtattttcttttccaaaaacaaaagagcagatggcatggaaagagataaaagatcatgcagataaagaaggaattactgtattccaaccagatgacagtcattcgccacatgctatatgttataataagactgtgtttttaaaagaacagaaaataagtaatatatttttgctttttagcaagctgtttattctgataacccttttaatcagtggtgtttttattatggttgttaaaaatctggccgaaatgtcttcttaccaaagacgttatgaattttttcattctatgggtatgaaacaaaaagaacaaaagaagaatttaagttttgagatttgcagtgtggggaatatagcattaggtacaggtatttgtttggctcttttatatgtaatgacctattcacattggtatgaggcaatgggtgaaaagatctcaactgctttttggagttactggcttaagcttgttggaatttatataattattcagatagttgtgcagaaattatttgtaaggtatgtgaacaaaagaatttagaagaaaggcttatagatgttgtttgttagagtaaattttgaatgcggtataaaaatacgcatataatattttactgacaaatgtttgcaaaaatcacttgccttttgcaaaggttcgtgataaaatttttgtcagtgatcaggttgcagaaacttgcgatgcctgcgaccggacggaggacctgagggccctccgtttttctatatatgcagatttttatagaaggtgaaaaatgacagaaaaagcgttaaaaccgataaaaccgtttttgaattatgaagaacaaatcaataatctcatcgagcaaaaaggaatgattgttaatgatcataaatttgctgtgtccaaattagaagatatcagttattttgctttaatagatggatataaaaatctgttttataatcctatgacaagaaaatataaggaaggcacaacctttgaggatcttgttgctttatatgaatttgatgaaaaacttcgtacattgatcttccggtatctttgtcattttgagcaaaaaatgagatcgctgatttcttatcatttttgtgatacttattcagaaaaacaggaagattatctgaatgctgtacattataataactcgggagcaaataaaaagaaaattgctgctttaatagctatactggatagagaagcaaagaaaagcacagatcacgcttatgtagtttatcaaagaaaaacatatggaaatgttcctatgtgggtcattatgaaaactttaacatttggacagatgtcaaagatgtattcatttctgacgaccagtatgaaaacgaaaattagccgacattttgattatgtaagtgaaaaagaactaattcagtacatgaaagtgcttaccttatatagaaacgtctgtgctcataatgaaaggttattttcatataagagcaggtttgatatccctgatacaatattacatagaaaaatgaaacttccgcgaaatggaaataaatacaaatgtgggaaaaacgatttgttttctgttgtgattgcttttcgaatgttgctggcaaaagaagattttgctgaatttaaaaaatctttgaatcagataattaaccagtatatgaaaaagacgggcaatctaaaccaggatttatttttcaaagcaatgggattcccggaaaactggaagaatataagtagatataaattataaaataatcaatatagtacgaaccgaggattcaaaatgaaaaccacggaaaacagataaatatataaatggtcaggaaggtcaatattttgatctgcctgacttatttttatgtaagaaaagttgccgatggaaagttctttgcattttatttgtaacatttatcaaattgaatagttaatattataaaggaaaggaggacagcacatggattttgattgtatatataaatcatattatctggacgtatatcattttttgtgtggtttatcatcgaacaaagaaattgcagaagatattacacaggaaacttttacaaaagcattggcggcaattgattcatatgacggtagaaaagatatacgtgcatggttatttacaattgcaagaaatacatattttacatattgtaaacgcgaaaaaatctatgtggaatgggagcctccaacggaacaggctgatatacagacggagtttattgaccatctgattaataaagaacaagtcgagaaaatacaaaattttttaaaaaatatgaaagatccctacaaaatagtatttgaattaagaatacatggggagctttcatttgaaaagattgggaaaatttttggaaaaagttctggttgggcaagagtaacttattatagagccaaaatgaaaatattagaatatatggaggcagagaataatgaataaaataacatgtaatgtaattaaagatattcttccgctttatatagatggggtggtaagtgaagatacacaaaaaatagtggaggaacatttagaggagtgcagtttatgcagggatgaaataaataaattgaaaaaaacattagttattccaacaaatgaagaaatacaacaagagactgtcaatatattggaaaaaagtatttcttctatcgaaagaactatagtaaaaaaaatcatacattattcatcgtattttgatctgatatttaatatcggaatgattccatttgtatattggctgtatgttgtttggataaaaaaagaaacatcccttttgaatatatatgtgtttgtcaaaaaatatggccgaatgagcggagacttattaagctttgctttgttttttgtaatctttatttgttgcgatattatccatattattttaaccatgaaaaagaaatatttgaatattatggattctgtagttgtgatgtcaattatggtaaagttatttcttattcttattctaatggcatttttaacagcaggtatattaatgtaagggggagaattcatgttcaaagttgtatggaaaagctttaagtataataggaaaaattttctttctttttttatgagtgaaatattatcagttgcagttatatttatgcttatttatattcaagaggcattgtcacaagttccaggaataaaaactgaagcgttacaatttgcatatcaaagtgaattaagaaagcagttacgcataatcattccatgtattattttaattatgattctggtaacgggatattctgttaaagcgtatataaacacaagaatacgggattataaattatttcaattattaggaatacgcaagaaaaatttaaaagtaatgattggtctggaatatgtaataagcggtatgcttgcatgtggttttggaattttgtttggtcaaatcggaacgaaaattataaaaggaattcttcataccagaataaatgcaagatttgtcaaaggcatttcgatgtcaagagtttatcttgtgttgattctaagctgtctgatcatgacgataggcgtatatattacattgcaaatattattagataccagaacggatttaggagataagatattcaagattaaggaatctcgaatcaattcgattatatcagttatttactttatagtaggtattttggttattagtagtggttatctgttggtgaataatgatccaatgatggcttacatggcacttatatgtattttgacaggtcttataattcttatgatattcggaactggattttttatggaaaaatacagtgagtcgaaatattataaaaagcatatattagcttggaatgattgctactgttacataaaaaaacatggatttcggatgctaatgcagatattgttgggaatcattttaatatttaatacatttttaatgcttcgaggtacaattcatgacagatatatgccaaatgattttgtgtgtatcggcaactcaaaagaaacgacagcagtaactactgtggtaacagctcgatttaatggtcttacaaaacaattcccgtttctatggtttaatgagatgaggggtgattcctgggttgctatatcacttagcgactataataaaatttacaataaaaatgaatcgttaaataaaaatgaaataataagaatttggagaaaagaagggagccgtaaatcggatctaagtgataaacaacatagaaaaataaaatcaatcgcacttggtaaatgcggaaatacggatgaagagggattggaatataaatacaatttccagataaagaaagagcaaatcaaagagatgatcggcttttctatgaccggtcttgtaattattccagataatatatttacacaggcagaaaaagaaagtgattataaaaaaatatttatgattataaatgtgccaaaaaagaacctgacagtttcaacacgatacatagaagaaaaattacaacaaggaaaactagatgaggctttttgtaagctgacaattcagggtattgataaaaaagaaaacgtattaaatcaaatggtagtaattctcgttgcgattattattttaatttttacgatgtttataacatggttaatgctgcagaatgatcaggaacatttaaagcaaaaatatcagctaggtgctattcttggtatgaagaggaaggaagggtatttatccgttgtgaaagaaatatccagagacatgtggtggtcccttttacttgcgatcggtataagtggaatgttttgcggcgtatttataaaatcttattattacggaacaacggaaattgttttgatacaaaaggaagttgcaatgttaggatgtattttatgcatatatggaattatttttatgatatttattattttttcaaccaggcgtttatggaaagaaatttcaaaaatatggggtgataagaattgatgagaaatatattagaagttaaaaatcttgtaagaagttacaatacagcaacttttagggattcaaaaaataatgtgaatgtgttaaaaggaatcagctttcaagttgcggaaggtgaatttgttggaatcatgggaaaatccggatgtggtaagacaactttgcttaaaacactcggaatgattgataaaccgacggatggaacgattaaatttatgggagaagataccagtgaactatacggggataaacttgcggatatccggaacagcaagataggatttatttttcaggacttttatctgatggacagcctctcagtggaagagaatatcatgctgccgatgatcataagcaaacagaatattaataagatgattgcagaagcaaagaaatatgcagaacaatttcagatagaacatctgttaaagaaaaacccttatgaattatccggtggtgaaaagcagagagttgccatatgtcgtgctttgatcaacaatccggatctgatacttgctgatgagccgaccggaaatttggactcaaagtcaggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccggatctgatacttgctgatgagccgaccggaaatttggactcaaagtcaggaaagattgtaatcgatgcattgaataagatttcatcggaatataagaagacaattgtcatggtaacgcatgatccgcagatggcaagctattgcagtcggttaattctgttgaaagatggtgtaatactagaggatttgaagaatagcggaaatcaggaggcgttttatcaggagattctcagaaagatgaaagagctgtaaaagattcacaaaaaattgacattgctgacttgaaaaagtaaattccagtgcaagagtaaattccatcatgttttaaattttgctttttgaccaaattgcatgaaagcaattcgagaggttttgcccagcaggaaaaaagagaaaaatacagctgataacgggtgtagattgtatcgctccatttataccgtttttgttcatggaatatgtgattgttccggggcgaaagggtactgtaatgaaacggatcataacctttgataaaaaagtcaggttgattatatttaatcttcctgactttttgctgatactccgaaaaaataaaagcgatcagataaaaattatttctatcaccatgcattcggaagaaactaccggtagcaagttctgtagatatgtcgaagtatgcaaaaaagattgttataagggtatttatggaaaattcatggtcagaaaaccgggtattcatggccagtataaggcggaagaagaaaaggcatgctataataagccaagaaattaatacggagacaaatcaaatgaaagactggacaagaaaaataaaaatagactttataataggcatagctttacaaatatatcttcttttcccatggatacagcatttttcaattgactgaattagcacgaatatatcacatattaaaaaatgaacagtcaagtgattatcgtggacttttttggattatatatttagctatcttttcgaggttttttgagaaatttgcttatgtagatcctatagataattctttgattcctatatatgtagaaatatatatatgtgtattgttggtttttatcggtctatggattctaattgatgcaatgctggatacatgggaagcagaacatcagatattaatatctcaattagaggaacaggaaaagcatgcattacaaacgaaagtcaagattttggaagaacgctatcaagaaatgttaaaaagccgaaaagtggttcatgatatgaagaaccatattctagcgctcaagaactatgatcaagagcagaactggcccggattgcatgaatatctgaatgaacttagtgatgatatgctggaatataattttcatgtctggactggaaatcatatgctggatatgatcttaaaccaaaaggaaaaggatgcacagaatcaaaataccgttatgcagattgatacagaagtcttttcgacactccattttacagaccgggaaatcatatcccttttcgggaatctattggataatgcgttggaagcctgtgagaaaatcaatgataaagagcgttggataaagattaagataaaaaagaaaaatctattgttatatattgaaattgcaaatgcattagaggaaatgccgaagcaaattcaaaaagaattcgtttcgaataaaaaagataatggacttcatggatatggaatgaagaatatacaggatattataaaaaagtatgatggaatcttcgaatataaggtatatgaagatcatctgatatttatgatttctatctataataactgataaggatagggggatgaaaagtatgttgaaaaaaatattttttaaactgctgggagaaaggaaaaaggattacataagagttattttaagtggaatcttctgtatatcggtcgtatttttttctacgtctgttggcagcagtcttgtttatatatcaacgggacgacgggcaactatgacagaattagtaatggaagttgaaaagaattttattttgccgtatgtgttactgatctttctcatgattttaattatattcggctatattcgtaaacgatccggcgattatgcaatgctcaatatattgggaatcaaaaagaaacacagatatatgtatattggctgtgaatatctcggaatcattttaggatcaattgcaggaggggtgattcttggaatattggaagcaatgatcgtaaaaaagatactggaaaatatttttcaaaattatgtaagcaacatatatttgggaatatcaccgttaattctcacactaattatcagcgtaatcatgtttggaatcggcttcgccctttgtgatcagtatatcgcctgtatcggaattgaccatataatatcgggaggaagtaatcataacagagcaagtaagaatacattgctattttgtcttataggagttgcagtatttattcttacattagtttctattgttacatattggggacaaatcggatatacgattccgacagctctaggaatcataacggcagttatttttactttatttggctgtagattatatcttgaaaaattaagaaaacgaaagaataaatattataaaaaaatcctttggctcgataactggtacgatcagtttttcagtcatgctaatatcagttatattgtcagtgcttttctgattgttattctgtttggatttaatattgtattggtagacaatcttcctgtaaggcagccggaaaattatccgtatgacatagtctggggtgccaatacaaaagataaagcatttatcgaaaagttaaaagaaaagtataatgttcagacagaattcattccatctatcagagtgacttcaggaaactgtgcagaacatactggaatttctgcaacagaatataaacgccttacaggaaagcaggttcatttaaaaaatgatgaaatatacgttgtataccaatgggaccgaagcgaatatggaacaattggtctggatttcggaaagctgaaaccaagattatacaccggatgcgctactgcagatatctggatttatactgcgagaacattaccaggtaataaatttacaagaaaatatacaattaagggaaatgacagaagaatcattaccgggaattttaaaacaagggttttgagtaccagcaatatgaatacggatgtgtttgaagatataattgtattttcagatcatgaatatgataagatcagtcaaaaagccaaagggtcaaaccttacagtagtaatgaacgtaccacagaattatgatgctgttgtaaataaaataactaattatgcagcaaaacattcacagattaatttctttgattatcatgacggaaatctgatctatgataaaaaacagtgcacaatagaagatcaggaaaaccggatgttaaatgtaagtgcgatgttgattgatatgcttgtgttatttatcagcataatctttatcttactagagaaaatatccagtgattacgaagcactggaatggaagtatttattctattaccgtacaggaatgccagagaaaaaacgaagagaaagtatttataaagaaataaccatgacatccaaagttgccttgataacaggaatatttatagcagcagtaatgatattggtgaaaatattatataagaaaatgccggtatattggacaaagatttatctggcagaagccgcagtaatgattataggtgtaaccgcttttatcatgataatcgtaaggattgcagcatggcgttcatttaagcgcagtgagaggagaaataaggatgaataaagaaaatatattagaaattgataatctggaaagaagctattcaacagtcatgccggacggagagacaaaggtttattctgtgctaagaggaatttcatttcaggtaaaacgaggggaatttattggtattatggggagttccggatgtggaaaaaccacacttttgaaaactatcggaatgcttaataaaccaaatggcggaagagtgctctataatggtgaagatacaacagaaatttatggggatcatctggcagaaatacgccggacgcaactggcgtttgtttttcaggatttttacttgatgaatagcttaactgttcgtgagaatattatgatgccattgatattaaatgaagatgatcctgtggaaagttctaaaactgcagaaactatggcagaaaaacttggaatttacaagctgttagataaaaaaccttacgaactgtctggaggtgagaaacagagaacggcgatttgcagagcaatggcagaaaatccagaattgatacttgcagatgagccgaccgggaaccttgattctaattcatccaaacaggttatccatacattgtcctacattaatcaggaattcgggaagacgattgtcatggtaacacatgacccgcaaatggcaagctattgcagtcggttgattctattgaaagatggagtgatattggaggatttaaagaatagtggggatcaggagacgttttatcaggagattctcggaaagatgaaagagctgtaaaagattcacaaaaaattgacatttttaaatttcatattgaaaataaaaatcaggcatgttattctatcggcacgcagatgaattctagtatctgcaatgcatctagatttaccaattcatttacttcaaacctaaacaatcgggtaagaatccaagatgaaaatcataaaaaacagataaatacatgcttgatgaaagaagatgacggtatatactggtgtatatataaattctgtgttatcatatgcataaagctaaacagttcttctttgcagatacccccatataggacttttatatttcattgtcctatatgagggtagcatatcacagtacgggcggctcattttctatctaaacggatgtatccggaagttccggcagttgatcggtgagttcttcatatccgagaatatctccggcacatggcatcgattgccctgttccctgctgtggtttccggaagtacagccgataccgatgtccctctaggagtttgatattcttttccagtgagaaggcgtattcctttccgttatcactggcaaaccaatattgctggtttttcccgaagagtgtctgttcccgtttcgtgcagcttacgtccagtgacagataagcatgtgtatggatcaggtggtagaaactgagtgcacgcaagatgctgcagattccgatgaggaggctcatgaggataaagagccggtcatgggtggcgatcccgaagatgcacccaaaaagtacacagaaaaagccgattgcactgatggcaaccagctttgtgaaaaatggttttggcataaggttccttcctttaacatgtatgaaatgtgatttgtttattcaggtacaaattagcaatagcctgcagcactggatactgggtatggtgaatctggacatcatccacaagtgtttggtaagttgtctccggttctgtgtataactcatccataatatccgattcgttgtggattactttttcctgctccatacttgtgacaagctcagcggtcgtgagggataccttatcagccagcttcagaatggtatcttccatcggtgaagagggtttcttctttaaatatctgccaaactcttttgcaccaatagttccttccagataaagctgaacgcagccaaagagccggatgggaaaggtatccttcaagggaataatggtcagactgccgagaaggcgatataaggcatccacccctgtcagtccaattccgcttacaaccagaccgcgtaaggaaagtcggttcagatagtgttggaaggataagcctttcggaccttctttctgtatctggcgcagggtataggcatcctggagttcatggagcgtcagaatctggaaggcaagacagctccagagcagcagctcgtcatccgatagtccatattcttgtccatcgttgattacaagaggaatggattttccgcctgtcgttttttgaaattttaaggttccgacagcagtataaagtgtcagcataaaagttccctccttcaaggttaagtcagaagtgcatagagtgcatcatcctgctgtaatagtttccgtgctttgctctgccatgcccgtacacgattggctggtacttggtagtgttttgccaagtcaaagctggtatatccctgctgttgcagatagagggctacaattcccttctgaatagttgaggactgtccggtgccaagctgggttaaatgatcaagaagcaaggtctggtttgtgtccttttccgggtgagttgtttgtgtatcctcgtaggaaaacaaatcacgataatggagatgttcatcttcagatgatgcttcgtccagagaacagagcatggagcggtcacgggcaattttccgccagtagtcaaagatggcatgacggatgatagttttggcataaggctggaatgatcttccttcctcaaatccgacagccgaccggcacaaagccagatatccaatctgacataattcctgttgttcttcctcagttacataggcagcggtgcgggtcatggaacgaatcatgatcggaaccagatccatggatttttccaccagttgtttttgctttttatttagtggtaaggtcatcatcaatcaccgcctttcagctggctgcccggaggcggaagggaatatggttgttctttaaaacatctgcggattcccgaatgagctggtcgcacatatagttgctgaactgtccgatgtgagcctgcttatctgtcagacagaacttatctgccacccagcgatatgcttccggtttggaaaggatgccctgttgccagatctgatcgaaaattcgatgtgcctgaatccgcttttgacgaagctcccggttggcgagcgttccttttggtatcttggttcccggatgtaccccgacataggaattgcaggatggatagtgggagcagacataaacctgtccgccatgagaatgcgttccatatacaaaggatgcatctcttaatattgctgttccgccgcagtaagggcagcggatgatttttggtttcttcatctgttttcacctcgcttgtacatacacgatacgtaacgtgtacgtgaataaccagtacgtactgtatacttatattgtaagtaagcaggtgatgaattcccataggacgcaagcggatactgatcccagattcggactaaatggcacgaatccccatttttcagatgccgggatagaaaattgctcggatgagcgggaataagccgctgtctgtgaaacgtggataattaaccggtgtaaagatgaacttctcacagaaaatccgtagcaggaataagctgatcagtaccagacagagcaggtaagtgttcctgcgccttctggtccatggctttttcggacggaatttcacatacaggacaaaaatcatgggaataaatatcaggttcgtaaagacctgatcgatacattggatgattgaaattacgtttaacataggcagtgcctcctttctttacatatcctgtacgtataagagcctgaaagtgcaactttttgttaccagtcatattgctggttctcctgaagccggagcagtgccggaatgggacatggctttaaaggcagcttctgagcggccagatagggcagataaagctctgtaaaagcagcaatgctcatgcttccggtacattcggttggctccggtatccggggaaacaaaagcgctgcatctgaaagagggaggatgcaggggcttcccgtttcatccggatggaataaaaagccagagttctcacagctttcctgtgcgttacaagtgcggcaccagacgtagatacaggagtgccagttcccttcacagaggttcagaaaatgacggatgtgcttggcatctgtcttgcagtgggggtgtttcatattcatcacctactaaagaagcaggcagttccatgtgggagctgcctgcaggagtcttcgttatgagttactgatgtttctttttgcgtttgaagtaaacgatgcccaggacacttgcacctgcaagtgcagctatggcgattccggcatacaggagaagcggcgtctcatcgccggtctttacaggcggagctaccggaggcgtctccggttctttcggaagctccgtcatgtgtacggtctgaccttcatccttcagatcctcatgggaagcaatctcatgctcggtttttccgtctgtatagtagagcttttcaaagacaaccacatcctgtccggcaagagcagaagcgtcgaaggtaaaggtaacttccacagagccgccagctttttctgctttaaattctgcctgagcggtaactggttttccgtcttttaacaaagcctctccggtttccttattcatcagggttccgatgactttgtactcagatccaggcatcagaccatgataagtgaccgtatctacgatagtcgcttccttggaagcagagacatcctgatccccgtcactgccgtctttggctgtggttttgatttccgggaagtagatggtctggttggcatctttgatgtccgcatgtaccgctacttcgtgatcttcaaaagtcattgtttcaaatgccacgagcgtttttccggaaagtgcagaggcatcaaaggtaaaggaaagctctacgctgccgttagcttcttccggagtgaaacttgtttctgcagtcacagctttgccatccacatcgaaaggtttttcggtttccgcatccatgagtgttcctgtcagcttgtactctttgcctgggatcaggtttttgtattccacaaggtctgtaagcgtcagttctttttccggttttgcatagtgtgtgccggaagcagcatctgttgcagtggttttgatttccgggaagtaaatagtctgtccttcatccgcaatgtctgtgtgtacggcaacttccttgtctttgtaagccagggattcaaagacaactactgttttcccttttaaggagctggcatcaaaggtaaaggtaacatctaccgtaccagcggattcttttggcttgaaggatgcttttgctgtcaccggttttccgtctgcttcgactggtttctttgtttctttatctatcagagttccagtcacttcatatttctggttaggaaccagccccttaaaggaaaccgtatccaccagcgtgatttcttcctttgcacaggaaatattggagttcgtgtccgcatctttcgcagtagtcttgatttccgggaaatagatggtctggtcttcatcgttgatgtcggtatggactgcaagctgcatctcatcctgatataattcctcgaagacaacggttgtttttccctttaaggaagttgcatcaaaggtaaaggttactttgacggagccggaggatttctttgcagtaaattcagtttcagaaatcaccggtttttcatccacaaggattggttccccggtttttttatccattaaggttccagtcagtttgtatttctggccctttttcagtccttcgtattccacaacgtcttcaatggtcacttcttttgccggctggctcatgtgtgtaccggtctcggcatccagagcagtcgtgccgatctcaatggcatcatcggtcagagttccaacctgtatcagaacagaatccttataaaccttgacttcaaaggttaaaagatccatgcctttgttggaatcacaacgctgttccgccagagtgtaagtatcgtaaatgagagcgcctttggaatcatccggtttggaggtgccgaaccagatgccgtcttccgaagactcaccccggttggtatttgcggtatgtttgttccatttggaggaagtgctggcataaccgttggcatctgtcacaatcacatggctttcgcctgttgttttggaagtgatcttaaatggcacatttgccagacggttctggctgccgtcagcaatcttgacaaattccagatccccgcggatgacctgattggagatggaattgtcttttgcagtcagttccacgatttttccctgttctgtgatgtcaaattctacagagatctttccgctgttcagataaccggaaggtgcagttgtttcatccacacggtaatgtccgaatgggagagcatcttttgcagttgcagcagaaccggatttatcggcagtaagtgtaaggacaacctgatctttcgtgtaggatgttccgtctactaataccggattttcatttaacgtagtgatcgcaaagacagtaccttccaaagtggcagaaccctgcggttttgcttctccggtctcgctgtcacgtttctggatcttcactccgccacggatgacagattcttctatggtagaagactggtataccgaaaccatttcctgcttaccgtcacctgtaattttctgtacgaagacagttggattgagctggtatccggcaggggctttgctttcctgtaccgttatggtaccgagcggaagacagacggtcttgccatcactggtatagtaaaaggcatcgccgcttacaaaggaatctttggtaaaatgcatctttccggaaacatctgtttttaatacccaggtacgtgccggtttctttccagcttccgcaggatcactgtcagactgctcggtatagaacttgactgtaaattctgcgtttgcaagggaagctgctccctgtggggaggctttctttgtttcggcatccagcttttcaagcaccagattcatgggattattctgcggaatatctgttacgtttgcagcagaagtctgttctgcttttacggtgactttgtgagctttggtgtctacaatgtagcctttggaagcagagagctcttttatggtataatcgccttcctccagttcgccggatctggcatacccgttttcatcagtggtcagtttctggatgagcttctcaccctgatagatcccatacacagcaccctttaagctgtaattcggattcccgtccgatacgcttccgttggcagaagattttttcagttcgatccagccgtttggaacctgataccagcttccggcaatggtctggctgccctgtcccggaacgatgaatgcccggaagccttccggcgggttcggaagtccctgaatggcactggctacttccagtgctttatcaatataggactgcggggcgccatggaaagctccggtgtcagcggaattaccggcatagatgtaagcgacaaccagatgtccgatgacatagctgttatcatcactccagccactgaaatatttatccttgacgactttatcgtagccgtaaccgccgtttaagtagtagagcgcttttctgagcggggagttctggcttaaaaggtcataggaataggaaccagaggaaggtgttttcttcagtggttccacgcagtaggcagtattgctcccgtcaaagctcatgcgggaggtaaaatagctgccgtaagggatattggcacctgccttatagctgatggtgccgtcggctgcatgaaccggaaaactgccggaaaacaatgcgccgactgcgacaaggactgccagcagcatagccagcgtccgtctggtataggatttgtatgtctgtaacataagtctcctccttcttgaagttcaaatgaaaagggcagcgtcagtgctgccaaaagttacacagcctgtttcttctgtttcgcaaggatttccagaagctcctgccgatctgtggtaatcagctccttttccagattggaagccttaaattccacagtgatgttattgttgttggttgagatcagaccgttgccccgctggaaatgggtgatgttcattacttctgtttccgatagatgcaggatagtcttcacccgctgtgcctcttcatcctccatgttcaggataatcttggtcttgcagttattgatgatacccttgccgtacttcccgtcatccagagcaaagaagtcgtttaaatcctgtgtggcaaagatgccggctccggagtaagcacggatgatcttggcaatctccagtacgaattccgctgcaagccggttgctggatgcaccgatgagctgccagacctcatcgacaaagatggctttctcttcggtacggttttccttcgctttatcccagacataatccagggcaacgaacatgccgaccgttaaaagatcgctggaaccggtcagttcggagatatccagtaccgtatatttattggtcaggtccacattggtctgctggttaaaggaagaagcagaaccgtgaaccaggcggttcaggatatgagccagacgtttggtatcctcgctttccagcaggacattgtagacatcctccagaatgggcatctttttgtactgctccggatgctgcggatctgtcagggattcatttttatgtgtaatcccttttctggcataggttttgattagggcttcatccagaagctgcttctcctcatgggacatatccgggatcagcagactgaagaagatgtgaagcctttggatcttgcctgccagtgcggaggcatccagtgtcggtccgtccagcagttcatttacagaattgtctaccttccggatttccatgatgttgatacagttcttactggcaggagagatctggataaattctccgccgacattccttgcagcccggtaaaattcgtgtccctttagcggagcgatgatgaacacctggatgccttttcttcgcatccttagtgccatggtctgcatggtgaaggtctttcctgctcccgaacagcctaagatacagatgttgctgttcttgtactgcctggaatcaaagatatccgcaatgaccagggaattgttatgcttgtttaccccaaagaggattccgttatcatcgcagatactgtagctgacgaagggatagcagcttgccgccccggaagtcagtacgttccgcttggacagcttaaaaagcttcttgtccagatttgccagcggcagagaggataaaaatccctgctcctgtaaaaagtagcaggagtgtaagttcatatcctgcgagatcaggagctttttcatttcctgaatccgccactgcagttcttccaacgtggaagcagtaatggtgatgagaagattcatgtaatagaaatcttcgttgttggcaagtccctgcttcagaaaatatccggagcggatggcagaatccagatcgtcataatcagtgttggtatcggacgcatcctttaatttggaacggttgatacggatctgctgaccgagacgctgctgaatcttgtcctttggctgtttctggagaaagaaatcaatatcaatcccttccccggcattgacaaggagtgacagccatccgggagttacccggtttttgtagccgtcagacggcacaagcaggtaggaatggtaaagcccattgatctgcacataatgggagtgcttgaaatccacactttccggtgcgagaaactcgttgatccggatgtgatccagttcctccatgcgattttcctttgtataggcggacagtacagtgctgatccggttcgaaagcggaacctccgtacaaagggtacggtttaaaagggtgtagagaacatccgtagtaaattcatcctcattgtcatgggagaccacttcattcccgcactggtatagaaaggttttggcggtctgggaggctgtctcaagagcagcaaggatttcccgttcctcttcctttcggtttgcgttgaatggttcatattcaaagatcagaaagaaccgtctggatactgcttctctggaacttaagttctggacaaactggatgtagtcacgctgcagttcctgacagtggggatcggtttcccgctccagctccagctgggactgctccagatgcttattgatgtctgcttttttggagatcatcttgatctggagtttgacagggctgatctttaagtaactgataaagctgtagataatgccctgctgttccctggcacttcgaagcagaaagttgattggttcaatctccaggatcttcacgtaccgtccgtctgtggtatagacgattccgtttgcgattttttccaccggaagataatcctccaaggtctggtctttctttcgctttttccgggaaacgggttttgacgtggcagatgaggtgtcctccttggaaaccaccttttttttctgctctttttttgcagcccgcttttcggaaactgcccgtttttcttcctcctttcgtctccgggcttccgtttttttctgtatttttatctgtttcgccgcctcttttttctgtcggctggcttctttctgctcccacttcagataacggatatcttcctttgcctgttttttgatgccccgcttggtggaggtatcaaactgccggtgttctttttttttactttttggcggagctggtgcgtccggttcagactgtgggggagccgatgccattactttggaaggctctgccattttttctgctttccggtgtttctttgtctttggctctttgaaacgtggtttcctgcgtggctttccttccggaagactgtcggacctccagattaccctgcggttcactacaaaacgcagggcattcatcaaaaaggcagtgatgctctccccgccgattccaatcagggctaccattgccgctggaagtgcggtcatgcagagaatgatgatgcgggcagtcagggacagcggcaggtggaaaacagggataccgattgccagggaaagaacaatgctttctatggcattgcggatgtcaaaagttccgtttaggatcttgcctttctcaatgaagttggaagggataaaggaaaccggtgtttcttctggctgtgtcatggctgcacctcctttttcgtatctttcgcatcttcggaaggcacagaggcactgccggattctgtgtccggagcttccgggctgtcagaagtatccggatacccgccttcctgcaggtgttcaatgtcctgcgaagtcagggacggcagggaatcatcggtttgcttttcgtaaacagtcgtatctgcagagacctgtaccccgtcttctccaaataaaaacacacccgtcggggtgtgataggtaaccggaagcgtatcctgatcggaaagtgaaaacatcaggcagacggttgtttcggtagggtagctggttttttccggcaggaaggtgatgcttgtctgttcttttttgacatactcttttaggtagacaggaaactgccctttgagagaagcaatctggctgtcggagaaaaatgcttttaaagcatcaaaatccagatattccggcatgggggtatcagaatttgtttctgttgtttcctttgccggttccctgcctttgtttccggaagcttcttttttctggcttttccagaaactggggagaaccagtccggcaagcagcagaaacagcatcagaaaaatggaaagaatcacttttgttctgttcataatggctcctttattttttgtcgaagatccagtaggcatttgccgtagcatggatttccgacatcatatcaaattcacggttaatatagttctttgcgtcactgtcattgggatcattgaccagtaccttgccgtttgccgtaacacctcggagtacgatgaagtgtccgccgctggtgaaaagtcctgcccgctgagaggagatgaccggacagccttcggagagtgcctgaagtaccgtattggcattgctggtctgtgtgacgctgccacagccgaaatgactggctgcagcctgaaagtagctccagtaggttccaactcccggcttgtaataggaattcccgcaccatgccaccgcatccggaggggtaatggtattcccggtcaggtagctggcgatcatggcaaagctggtaggcccgcagccggaagatgcgatggagccgccgccataaggaatgttcccgtaatcggtctggagatagtgcggaatctgcattccgtttgccggatagcttccgccggtattggtaatctgataataccggagaacatgctccacatattccttgtccccataccggtcataatgccagttcggacgggcacacatcatatccgaataagcaatggcgttttctttggtataaccgccgtcacgttccattgcccagtcgatatagccggagccgtaattgtaaccctgaagcgccagcttgatgcggtccaggtcggtaggtccggtacatcctgctttatccagtgcatactttaattcctgaatcccacattcgatggaataagcaggatcggtgatgccgttggggacatgggggtatttcttattaaagccgccttctgccgcctgcatgggatcgcttccacgcccgccgctttcctgcatcatgactgccatgaggagttccacataagcttccatgccgtatttctgtgcgacctgctggatggtagcccggtaagccagcacctcatcgctgacacctaccgccatggcaagaccggaagcggagccgccaaagaacatggtcaggttttccacataactgtctgccgtttttttctgcttatcggtcagatgaaagacgtgatctgcaaagtaggcatctccggcatagctgaccgtgtaggtatggcgggtaaaagtaacctttctgggtggtgcattttcctcttccgccggaacttccaccgtggccgtttctgaagtaacgtcataagaaaaaagcccgtcctcgttttcccggatcaggcttttgagtttgctgatatttatatttttatagtcatcctggctggcacaaaactgtgcgatgagctggttcgcatttacgatgatactggaagcgtaaggatcgctgatagaggcagtatctccttccgggagtctggcaatttccgcattgatcttagcaagcagtgcatcatggctttcctgaagcacctccacgattgcctgattggaagcccggatattttcactgattaccgtgttgctggtcagtgctccggtattttcagagaggtctccgaagacgagtcccggaagcatgacaaggaacagaatgggaagcatcagtacaccgccgacggctgctccagttttcgcaagggtgcgcctgtgccggaatactgtaccgatgacagcaagaggactgcccatcaaggctgtttttggcatgttacatacgctcctttcgctgtggggctggcggcagtttctggacaatggattcattgtaggctactttgccgctgccggaagtatatggtgttttttcgaccgtatcctgtgcatactgcttgtaccaggtggaaccatccacggactgtaccgtagagtaggagccctgagtaggagctgcatactggtcggcatggtacagggcaaaatcccggtttccggagcttccggtttcggtaccggtgatccttccgccaccgatttctacattatcataggaagaaccgccgcccggattgatgcccatataggaagtaaaggctttctgtgcgtctgctcccttgatggaacctacctgaccgtaatttccctgtgcaatgttgctgatgacctgattggcaaagtctccgcctttgttcagggatgactggtagagcatgtttccgatactgctgtgttcggtataaccggttgcggaattgaccgcttctctttgtacctgtcttcccactgccccggcaagcccgccggataggaagcttcctgcgacagccgcacttccgggagaagaggctttgtggtagccgccaccaccatgggaacgcatggaaccggtcaggctccgtcctgcaatcagaagttcagccatcatgtttcctccggtattgccgacattgatgccaagcgatgccagaaaagaatcaattttctgggatacctttaaaaaggcaatggcacacaggaaccagacgaagacatttccggttaccgcttcctttccctgactggcaactgccgcttccacgtctgcttccgtaagctccgctgcaaagaccggcatggagcaaaacagtaccagacaggcagttagtaccaggaatggtatgagtttctttctaagtttcattttggtcctcctttcttatagggataacggattggcaaggaaggtgccgaccatagaagtaaacagccgcaggcaccacgcattcatcagaagcaaaaagaactggccgccaagcatccggcaccagcttttgaagatatttccggttgactggctggcacccatggaaaaagctgccggggctgtgtagaccagtacccccagaagaatatagcgttctgccgcttcaaagagcagtttgatgtagttccacgccagaatcagtaccagaatcagtgcaatgatggctaccgccccatttgcacagactcccaggatgactgtgactacggagttaaaatccgcaaattttaaaggcggcaggtcttccgtcagaatccagttgtacggtgttcctgaaatcttcaggagcagatccacaatatctttcgcatagaaggtgagaaagataaagaggaaggaacggatggacagcttaatgggatcttccgcttcgataccggctcccataaagtaatttttaaagagctgccatacccagtttaagaggatcagcccgatgcccagtgccagaaagacctgatacatggtctcggcagcaggaaagtagcgaagaaacgtatccatggaacagcccagagcaccgaggactgaagtggtgatcagatccagaatgttcatgacctgttcggcaatccattccacgattccgtcaagtattcccatagtggcatctcctttcgtctatccgttccattttccgcctgcaaagaacggggtgatgtaagccatgataaagccaagcccgtttaagatcgcccaggtaatgacgatacgcttgagccatgcacgtgattcgtccacggtttttccgcttttggaaaaattcatcatcagaagggcaaccgatgccgttacgactgcagcaatggtggaaatgaggataatctggttatagacatccttcatgatctcattggctttggtccagatggtagcggcaaaaaccggctgtgtgtatccgcagaggactgtgacagccagaaatgcagcatacaggcatctgccataattgacatgccgttttgtgtccggcggagcgtttttcagtttgtgtttcacgtaaaagtacctcctttttataagagcggcaggagaattacctcccctgcctttgcttatggttttcctgcctcaagaaaggacgcagcccggtcaatgcaggctgcgtcctaaatcaaagtatgaaattgtaaagatcctcctatcttacagaaaaaacgcagcttatttgccgcaggagaggcttcccatacggcagtgctgcgtttcgttctgcatataattttgacaatatcaattttaacatgggtaaattaccgctacaatcgcaggactgtgccagttacagacgatggagtgccaaaaatgtgaccaacgctaaaagcgttataaatgcaatccttatggatactgtaagcgtgatttgcaaccaattatactggatttacatgactaatgctttaagcgttagtgaatactggaaggaggaggtgtgcgtgtgaaaggaatgggaaaggcaatccgcaggtacagggaagaggcaggaattacgcaggagagactggctgaactggtggatatcagtaccaaccatctgggtgcgattgagcgggaagtgaaaacacctacgatggaaacatttgtaaagctgttgaatgtattaggtgcggaaccgaatgaagtgctgaaggaagtgattcctcttaccagaatggaacatacttctgtagtggaaggaaagctggaaaggctcacaccgaagaagcaggaaagcgtgcttcggatgctggatgtgataattgaagagatgatgaaatagaagctgtctgcgaaattgccgcaggcagtttttttgaaagctgtatatgcaataaaacacataaaaatatgcgatttatgatgaaagtgattgcaagatttgatatagtaatcctaaaagcattataaaactaattcttaaaggatgactataatatgaaaaagggatatgtgggattattggcatgtgcgtcaggaattctgatcggactgggaatcagccggctggatctgacaggttatcttgaaaaaacacaggagcaggaatatcacccggtagaaagaaaggtgcctgaatcagtagaaagcaagctgaaagatccaaaacagtgctggctgtgtggaagcgatgaacggagtatgatggattatttccggaagtttgacgatctgggagtgatctgtaccaatcactggtatgtgatggatatgcatatccggaatcatgatgaggacgggaatcttaccggcccgcagggaaacgggcatatgggttataccgggacaggagaaggcggctgctttttccatacggagcagatgtcggattacgggatttccgaagtatcggtggattacggggaagatagtatcttcgatgtgaaaaaagtacagaaccatctgtgtcaggaatgcctggataagctggtggaaagcatggaggtattctgtgaggaaacgcaaaaacccaagccccgtgatctggtactggtggattttcagacattggagctgtacgccattcaggagcataatgcgggatactttatccgggattattatgtggaaattgagtcggaggaagatggggtggaagtaaaggcattttactgcccgaagcttaataacgggaaaaaggatggagaataaattgaggtttgcattggtgaggagtataatgtaagtacgtgttatgtattggaaaaacttgaatttagcagaaagaaggattgttatgaaatttatcaatactagaaaattcacatggataatttgtataataggatttttgcttgctcttgtaagtatatttttcttaccgagtattattccagtacattttgcaaatgggattgcggatgattatggaagaaaaatacaaatatttttatttcctatattacaagtgcttatcacttttttgactggacgagaaaaagtaaaatattgcctgacacattcaaaaactttcttaacggacattcagtttaattggatgatagatggtgtacttttattggtaatgtttgcagaaatatgggttatctatgcttcatttgcatagaaatacttgcataacaatttacatttgattgagcagataaaaatgatttgaggtggtagcaatgaaaaagcgattgggaatcatagccggaattttaggaattgtattggcagtcattggcattgtactgaagcagaaagaaaacacagccgtttctgttattggtggtgcggatggcccgacttctattttcatagcagggaagttaaatggtgataattttatttttatgattgtagttggaattattttattgattttggcaggagttattttttacaaacgtaagcattaagttacagttttttagactgtgtatggcggaagaaccgggaaagtgtagatatatcatggggattttggaaaaaaataaaaaaagtaagggtacagcgtttgtctatgatgagaataatgattactataagatggaaataaacgggattgaatttgtctgtgacagtatacattccgattatgagaagcatgcagttgaactggcacaggcgtatgagaaaaggctgccggatatcgtggattatcttatgccggatataaaggagatgtttggaattacaaatccagatgtaatagcaaactcactaggaaagccgagtatagatttggatagaggaacactgacttatctggagcacacaatggacagcctacatattattgaaatggaatttgacggtatcttcacggcattctataactcctgtattgatggataggactttagtaacatagagctgcagttgtctacagcttttatccagacttcggatgttacagagaagcaatcagaaatggattgatcgatttctgaagcagtatccggtgaaatccttgaacatatgaaggaaaagtatgtatgttaattttatttttattgtagacaaaagataggactgatatgataaaagaacaggttattacaaatagaggtggagtatttgatgcagaaaatattattactggaggatgacttgaatctaaatcggggaattgccctgttactttcacgggaagggtatgaggttcgtcaggtttatacaataaaggaagcaaaagaagcatttcaaaaaggagattatgctcttgttatcagcgatattacattgccggatggtacaggactggattttggaaggatggtacgtgcaggtggagatacatatcttatctatcttacggctttggatcaggaaatagatattgtaaatggttatgatacaggggcagatgattatattaccaaaccattttcactgatggctttggtgtcgaaggtgaacgcattgatgagacggctttctaaggtacaggcacagattatgtcttccggagagattacggtgcatatgaaaacgatgcaggtgtataaaggggatgaaccagttactttaagtaagaaagaattctctctgttgctgtatctctgggagaatgcaggacagattgtttcaaaagaaagtatcctggagcatgtatgggatatagacggtcaatttgtcgatgataatacggttactgtcaatataagcagactgaagaataaacttggaacagaagagatagcgaatgtgagaggactgggatatatatggaccggaaaggtaaacaaaaattaaaacggtattttatcgtatatgtaatctttgcagtattttttacagtaggaatgtatctgataacaaagtatgaggaaaatgcgaaagcaacgcagatagcactgctccttgcagaacatcctgaactggaaggggaaatagttgcaatctgggaaaagtcaggaacagtagattttataagagaccgggacgatcagaagatagaaagagtcgtacagatgctggaagaaacttatggttatcactcagggagtggatcttcagatgtggttataaggattatctggggaattggattactagtgggagtcatagtatgtagcctgttcttgtacctggaccgaagaaaaaactggagcagatacggtgatgaggaacaattacagcaattatatgaatgtctgcaggaattcagaaaaggaaaattccaaacatatcctgaagaaacatcagaatcggaacaatggttaaaggtgtgggaatctgtaaaggagctggggcaatatttcgaagatttgaaggaacgtctggagcaggaagaaaatggtacgaagagtctgattacagatatttcccatcagttgaagactccgcttgcatcactccggatgagtcatgagctggtggcagaaaatcgggttacaggagaagaacagagggagtttctggagcaggaatcacaggaacttaccaaactggaacagctcttgaatgaactggtaaatctttcaaggctggaaacacatatgatccagatacattcgcttcatgaaagcctgaagaaaacgctaacagaggctgtcagtcagatttatatgaaggcaagaggaaaagatatttccattcaggtggagatggatgatgatatagttgtgaaccatgattcaaaatggacggtagaagcattaacgaatatccttgagaatgcagtcaaatattcaccggaacatacaacgattacagtgaggacgcaggagctagcaagcaatgtgcttattgaagtagaagatgaaggaatgggcattcctgcggaggaactgcataagatctatcagagattttaccggggaaggaaagcaaaggaacaggtaaaagacggagcgggtgtcggtctgtatcttgccagaaagatcatagaagaacagggggggacaatagcagccaaaagaaaggctgagaaaggtatgatatttaaagtgacactgccgctcataataggagaatagtcggaacccttacaaaactgttatggttgttgtaagggttttgtaatgcaggaatgttatagtaggggtatgaaatggaaaggggacttgaagatatgagtagtattttaaaagtagaagatctagtaaagtattatggagaaggcgagaatcaggtgagagccgtggatcatacaagtttacagatagagagaggcaagtttacagctatcgtaggacgttccggctccggaaaatctacacttctgcatctgattggagggcttgacagaccggattccggcaaagtatggattgatggaaccgatatctattctcgaaaagatgataaactggcacagtttcgaagaaagaagataggatttatctttcaggattttaatctgattccatcgctgaatgtgtgggagaatatcgttcttccgctgggacttgataatcgcaaggtaaagccgcgggaagtggaagatattctcaaaaaaatcggactgcaggataagaaagatgcgatgccgtctgctttgtctggtggacagaaacagagaactgcgatagccagggcattggtgacaagaccggcgataattttggcggatgagccgactggaaaccttgattcccagactgagctagaggttatgagcctattgaaaagctgcgtgtcggatttcgggcagacgcttatcatgattacccatgatgaaacgattgcccagatggcggatgaaatgattatcattgaagatggcaaggcggtgagaagataatgaagatgacgaccagagttgcatattgcaatatgcggcattataagagcaaaaacatactgattggaattgccattatcctgacaacattactgctgttcgtaatcccatcaatcggaaaagatatggtggaagtgaactttgcggtaatcaataagatttatccaacatggcatgccctttatcggaacgtggacgagagtacagttatgaaactggcggcacatcatgatgtgaaaacttacggactccgcagcgatgcggggtacatgaatctggaagatgcgacggtttccatgatgtatatggacagaacagggatggaactttataaagtgaagctgaaagaggggcaacttccgcagaaagaaaatgatattgtggtttcaaaaggaatactggaagcattaggacagaatgggaaaatcggtgacactatcacagtaccttatcagattctgaaagatgacggactggattatacgaaggagaaagactttcgaatctgtggttttttagcagataatgagagcagcaaagaacaaaaacaatatacatcattggtttcagaggcctttctgaaagcggagataccggtagaacaggtgaaatatcggtttttacttcaggtgaatggacagaaaggaaatacgactgcagattatacagagacgatacagaatattgccagacagttcgggatttccgaggatgacatgaatattaataaagagtatcttgcagcaaattatgtggatccggctacaattccggtgattgtaggaatcatgcttattgttgtattggcgggcattatcacaatttatagtgtttattatgtatctatgaaccagagggttcgggaatttggaaagttaaaggcaatcggggctacgaaacggcagcttagacaaatcgtactaagagagggaatgggagtggcgttgtttgccattccgataggacttttgatcggaacagttgctgtgaaagttgtacttctccagtttgtagaacatgcaaaggattcaaacgtacttataacagaggcatacaaggttgtagctaaaggagaagtccaactttattattggtggatttatctgttggcaattgcagtgactctgtgtacagtgtatctgtcactgatgaagcctatgcgtatggcggcgaaggtatcagaaatagaagctatgcgttaccagggaggcagtaagcgacagaaaagcagcaggaagggatatcaatttctgaatatcggacgactgaccaagagaaatcttgcagagaataaaaagaagagtactatcacgattgtatctatggccgttaccggaatatttgtcatgatggtagcaacggtgctgtcttgtgcaaatccgatggaaagtgcaaagagttcgattgtggggcaatatgagatttctccaattgtggaatccgggaataaagagcatcctgaatatgaatgggcggaggttcaaaagaataatccattaaatgaaggactaaagcagcagatagaggagcttgacggtgttgagcgggtagatgtgtttaccgcgttgaaggtatcaggaggaccttttgaagaaaaaattggaaccgaatttatcaatggagtgccggaagaatacgcagaagagctgaaaaaaggaatcactgaaggcaatgtcacatacgaggaattgaaatccggggataaagtgattctggaccgcgcgctacttcactggtatccagatattaaagtgggagataagctgaaactcaatattcatgatggagataatacctttcaaaaagagattgaagtggcagcaattggtgaatatggaacaggtctgacaaactataactgtcttatcatggcaaaagaaggggcagagaaacttaccataaataattcttccagctattttcaggtgattgcagataaggattatgatgaggcactggaagcatctctacaggctattgtggatggatcaggcagactgcagatgcgtacctggaagaatgagtacgatacatgggaaaatgccatacagatgactagaggtgcatgttatgcatttatcatcattctggcagcaatcagcattatgaacttgattaacacaatgatcaatagtgtccatgtgcgaaaaaaggagcttggcatgatgcaggcaatcggaatgtcggaccgtcagttgatgaagatgctccagttggaaggtatattctatacagtaggcactcttattatcagtatcggagtgggaagtcttgcaggatatccgttgtttttatatgcaaagcgtacaggaatgtttgatatcagcacataccattatccggtaacagcagctattattataattttaacattgtttgtgatacagatgttattggcaatattcattgcaaagtcagtaaggaaagattcattgatagagagaattcgtttcagtgagtaagaatataaatttctgatgtttaatgcagatactaatcaatgtcataataaaaagggggacttgatttctcaaatcccccagtgtataatgaactcaagaaaggtattcagatgcaaaatctgatgccctcagttaaattttatattctatgtataagtcatagcatccaaaactttcctagggtcgtggatgctatttcttattatgtcgatctatataagtcaaagccgcaaaaattaccaatagtaaagtcaatacttccattgtattcatgggcatcaccctccttggatactagagggcaaaatcgaaatgcatccgtctttccggttcagtaataccgaatcagtataacacgttaccgttttcagtacaataaggtaatggtctgaaaaatactttattctgtcaccttatgtagctgtatcgtgagtatttgctggactaattggtgctgtatatgaaaaaaagctatttaaaaataaggtggaagccttatatggtctgcttgatgatgcgggtgatgatgccgagggcaacattacgctcttcatcaatatgcgtcaccacaaaggatacctgatcctttttcccgactgtccggctgtcatagcaggagtgggcaatggcattgacaccgatggagagccggacaaagacggtgcctttatggatgtcttccacagttccggcgtattttccctgaatcttacattttttcatgttttccttgctggtgttgccttccacacttttgacatctgcgtggacaatgacctgctccggtgagtctgcccgcacatccaggatgcgtaccaggatgtgatcgcctacctggaagcgttctctggcatcacccatccagtcgaaggacaggtctctggcaagaatggaggtttccacaccgaaaatttctgcccggactaccttttccgcaacagcaatgactcttgcctgcacgatacggtcttcataaactttcggcattccggaagcatctttatccagatagaagatctggcgtttcttcagcatcgcttctttccggctggcgacaatgctgcgtgtcttcggatctaatcccttaatcagaaaatcaatctcacatccaagcatattgttgaggattttgttctgccgcagagcaagctccccataatcgtgtgcttcatcctgcatgagatggatcatcatctcagttactgggatgacagtacggaaatccttgtagtaaaccacggcaatgaggctgccgttttctgttttctcgataccgccaagcattccggttaagatccggcgggtacggtaggcattctggatctcatgccaggtaaggtctgaaatggactgggctgtttccagcttcgcatcggaatccagagttaaaataggtgtgttggttgtttcgtttggcatcatagtgtctcctttcaaattatgacatgatagaatctttatctaaaggaaccatgtctgtgtgatccgaatagttatctgctgagaagtcatccgggaaatcgtgatagccaggttcctgataaacgctttgctggtcaaagtgcggttcagcttttttctttttctgctttccataagaagcggtttttttcgggtgggaagcaggaatagttggagtgtacgtatattcttcactacatgctccttttctccattccggaatatgttcggaagccttccggggaatgagtttttgggcatccgggtgcagggtgtaatcgtatttttctacctgcagtaccttctgaccacgcaggataatcagtgcagtatccagcgggagccgcaggatctcatccggagttaagagctttcgtttcccgatggatctggtctggcggtattccggtgtataatcggataccctccagctatttaattgtttggcttcgctgctgacaccaacggtcacatcaccggagcggttagagataaatgtagcagttacctcatccgtacagcctaaaaatagctgagtgtcgcagttcccgatgatttcctgccattggtttaagggataccggttctgcatctgaggcaggttttggaaaatgcaggaaatactgaggtttcgacttcggatcacggaaatctttttgttgagcgataggattgctcccgtattcgccagctcatcagccaggatatgtaccggaaccggcagttttccatcttccccataggtgtctgcataacggaccagtttgataaatacgaaggtcataaacagggaagaaagaaaatcaaaagtgctgtcttgatccgaagtgatgcagaagtatgcacatttttcttttcccggcagcgtcaggttgatctcatcataggaagtgatctggcggatcagcttgttctggaatacctgaagtctggaaccgagtccgatgatgacgccggaacgtaccgtgtcacttgcctgcttatagatgcagtaggggacttttgccggatgggagaccggaagcaggtcaaagaggctgttcagttctttttccgaactcatggtcaggagtttgtatacctgtccgatattctttgcctccggtgggaatccctgatccacatagagaatcagagcttttaataagttcatctcggcattgtcccagaagtgatcgcctttggcagaaccggtattctggatgatgacatcagcaaatacctgtgccatggtttcctgtccgccaatttcacccagacaattccaactatccgagttttccgggtttacaagattaaaggatttcacgatatatccggcattctcaaggtaagtggctgtactttcgtacaattccgattttggatcggtgatgatgaggctttccccgcgggcaacacactggaagatcatgttgcgtgcaaaggcccggcttttcatggaaccgctggcaccgtaaacggcaatattccggttcatgcgggtatccttcgggagacaaacggcttttccgttcagttttccaagaatggttcccttgtgtttcttgacatcattcgtaagctccagtacctgatgcatttcctccaaagtcataaaaccggaagtcccataggttccctttgtggaataattcaggttccggccccggtctgttatttccccgtttcggtcaaatcccatacgcatgagaaggaaggtcaggagtccaaaagctgccagacatagaaaaatcccatacagattgtacgggaaagcagtcagggcatccagacaggcgagcgggtgcggggaggggatctgcggggcagttccgtttccggcaaaattgccggcagattcccaggtctgatagttgcggataaattgagcaacatagcctcctgcatagagggtgcagaaggtgatcggaagcatataaatgagcttccaccatttacggttcatgtaaaaacccccttttgaatttgcaaaggtcaatactggagaaatggattgtggcagttaagtattttttcaggaccggaatctgaaaatcgaaacagatcaggttcccggatctgccgtatacatttaagccggtattgaaccggttgattcgctgcatgtcaaaatcataagcaagaaggatggggttcccggaagcatccgtggcatcatgttccagtggaattgaatcgctgcggcagcccagatcggacagcaggaggttgtccagcttttccatgatctcagggtgaaccagcagttttaaaagcacttccccttccggagtattgggaaggtaatggaaatgctcgaaggaggtgtccagcataaacaggctctttttgtagcctccggtactggtaaacagccggaaagccatttccatgtcggttccggtcatgattgcccggatctgtggatgtccgttgtaagggtagccttgcaggtaatgctgcaggaaggcgtttaagcggacttccgttcgatattcccatttcaggactccgtttcccgtgttataaaggacatagacacattgcggtgccatcaggatgcccatgctgcgggagttcctaatcttcgtggtctccgggcccaattccttaatttctctggaagcgtaaaaaagaggaaggcttcgcataccgatggaaccagcttcgcggtgattacagaagatgtcaggttttacatccggataaaagggaatcccggcatgaaggagtgtcagatacgtttcggctttctgatgtaagcggatacgtcgggatacttcacttcggatgaggttcgtctcggtattgccggtcagatagcactggaagcgtagcggcgagacagataacagcatctctttcgcagcttttgtaagacggtagcctctgagagcatcccggtagtgggtacggatgaggtgttccgccttcaaatccgtaatgagtttttccgcataggaggcacttgggatgagtctgtttagctggtctgcgggaaattccccgcacatccctatcatttccagtaagcggtatttcgtagtgtcaggtcttatcaaataagcatcacctcaattcagttcttacccatgcaagcctatacttgggtaaatctccggtggtttggagataaaaaaagcaagaaaacaaagttccctgcggtggttcttaccgatgtcggatttctgcctgagaagtcaggagattttccgacatgctttcgtgatgatttttctggttctgcagccatttcggaaagtcagctttttccataaccgataccagtgtacagtcctttaagccaagctgtgtcgtgtagtaggaatcacagaaaaagccgctgtcatctgtcagaacataagtacaaagtgtatccagaatctgtttaaactccagattgtcataatcccggatacgtctttgaggaagttccctgtcatatatttgactgaaacatatcacgcagtcacgatagaggggcagggcattttgttttacatactcccgaagcatataattaagcggttcatggagaaatgcagtgtttgtgtggactcttcgtttcggaagcagtccgggaagcgtaatggtgagaatcccctgctgttctgcaatccgcattccctgtgcatctgccgctttgggaagataagctgcttgatttggggagagagccggacagacaaggttacgcatctggcaggcaatccgctccgcccgaagagcagcactgacgctcagttcctcaaaatttttatcataattctggatatcagtgaccttcagagcgtaaacggtattcgtcagtttttgcagctccccttccagtttttcaagccgctggtaaatggttggtgtattttgcgtcataataacctactttctcatgtagtaactgacagcaccggattcatttacaaggcagtaagcggctacatcatcaatggtgattttggcagcctggctttcggattctaagacaatcaggcgtttggaaccatgtgatgggatactttccatcacatgattgatcagagcctcctgttcttcaccgatatagatgatttcgtattgttcatcttgcgaaaagaaattgagcttgattggaaattcgccactggtgtggtatacaacacctttcttaaaatccagcagtacccagaagcatgtaattatagcatagtcaggattctcagcagactgctggctgtcacaaagaaggtcatgctctttatcgtaaatgatgcgcccttgtttgatgaggctggtaatcaatgacttgatagactgctcatgtcgggagaaaagttgtaaaacctggtcatacctcagagtatggtaagtggtaatgaaccgtaagagcttggctccctctccttgatagatttcgttccttgttttcatgattgactcccttctatatataataggaaactttatacatatggctgtacgtacaggatacgtttggtattgtaagtatagtgtacgtacaaagtacatagaacctgctgtcagcgattgaatttacaggtacaaaaaaagcaccatctatgggtgctggaaataaggaaaactataagcaatacctattgtagcatgggtaattttacgcttcaatcgcagaagcaggtcatttctgtgccattttcactggttggcataaaaaaagcaggaaaccattttgattccctgcatggtgtattgttgtgcttttgtgtagttctaatgattacttgtctttataaaatgcttcgaaagcttgtgcgaagaattcggctgtaccattgccgtatttttcatctatcataggtttgattttttcattacggtaatattgagcctgtgcaaccatcagaccgtgttctttctttatctgtgaaagttgtttcataagaaaaccgtattcggaaacaagttctcttacttcagaagaatctggtgaacatacttttttagctgctaatttgtataaaagattgtcaaattgttggttgtaactttctgcagcctctttgctaataggattgttggcaacagacaggaattgctcttttcctccataccactcaacaactttagcatagcctttctgcatttcttctgatgaaactgtcttaatataatgctttttccattcttcaatgcttccaaactcttttacagcaagttctttcatattgtcaggcatatgttcaaacatagtttggaacatttcttcaacttccgttttactaaaaatcgcaaaatccattttattctctcctttcaggatatcatcaatgctggcaatcagatgttccatacgttctttctttgctaccaacatttttctctgcatttgcaagatctggttcctttcaagagcaggattctccagaacagctttgatttctttcaaaggaatgtcaaactcacggaaaaacagaatctgctgtaatatttccaatgccctatcgtcataaagccggtatcccgcatcacttttttgtgttggttttaaaagcccgatttcatcgtaatagtgaagcgtgcgaacgctgatacctgtaagttctgatatttctttgactgtcctcatagttgctgacctcctgttcctgataagataactgtacgctatgacgttccgtgagagtcaatatatattttgcattttttagtataacatttttatgatattacgaaaagccgaggagataggcgatatgtattactctggaaagaacttgttgagcgtatccaatgtctcttttgcagtaaatccccaaaggatggtactgagtgcttcaatcgcagccctgcgtttccggtaataggtgcggtaggaaatattggtgatgtggtgagccagcttatccaatatctcatctgtatttttcatttcctgtggagagagaaaagcgtagtagagaatccagtaatactgttccccatgcttgtgattgttccggaggagatcgatggatgattccaaaagcttcagcatctggttgcttctggcaatactttttgcccgttgttcgatgtcgcttccggtaagatcagccccggcagcatagatggagtccagaaatttgtcgatgtcattgtcgtattggagcttaaactggtgctccatctggtgtacgactaccttcaggctgtaggttgcatcccggtatctgcgtaaaaactgataggtgtcgtgaaaacgtggatcttcttcgggtgaaggaaatccctgtgtattgcggtttgccatgtctattccccccctttcagtgcagaaggctctgccacggcaggcatcttttgggcagactcatcccctggacttacggacaactcaaaccgataagcggcatttccgtagggacagataatatttagagtaaatgtattaaatatatctttgcaggctgataatggagataatatatagcgggttttggagcagtggcaacatggaatcccttgtgaatccaatagttctgcgactttttgcacgataaatttcatgtgtgaatctggaacgcaggaatcattttttgtaacggtgatttgtgagtctgtgacagtttctgaaacgctaacagaagcagaatcctcaatagtgatttcttcaggtacatggattggtaattgcatcttcatagcgatctcctccttgtcaatcataacgtcgctgatattaaacatcacggacaggtaattgttgagataaattacgcttccgtgttttcctgtaaatgagataagtgtaatgtattctttttcctccagtttcttcaagagtcgtgataccgatgcctttgacagactccacctttcacccagttcattaaagctggtaaggggatttccggtattatcccggtaatagacaatgggaccggaatcagatcccaggacagaggaatcgttgtaaactgcatgaatccacagatccagaataacatccatttccgagcattttccaatgccaattagttcgtgaactttggcaatcgggaaaaagaaaaaccctgtatcttttttacagggatagttgtattccaatacggtattgtctttgggccagtctgatattttgaatttgaccaggcggtttttgccgagaagagagtaggtaatgtaattctgctcttcaaaaaatcgaaggatggacaacgcttgatgttggaaacggcagcgaaaccattcctgaagatctgtgactgtgcagatccactctcctggaccaatggtataggtaatgtgttccatccggcggtaggatgtgcggtaatttgcataggagcataataccagataataaaaaagaaaagagcccccggtagttcggatgctcttggtagtgattaaagtttgtatgaagtcacggtaaatgcgacagcgtggaaattccacgatttgtttgagttctaatttgtaattcatggtgatcttcctttcaaagtatatttaattgtaatcggacttttcatagtgttggtatcaagaagaagccgatggaagtatagcaagtagtcgtgtcactcattgcatttttattgcatttttaaaatttagattatgtggctatgttgctcttaactggttaaaaagcctttaaaatcgtctatatgcgttaatactccgtactgtctgtctggagttcgagtaatccacacaattataagaactcagtatttatgcgggttgcaaacaaatttgtttagtgattggcaacaaaatggcaacattttgtggttattcaagagataaaaattttatttcataacgtatataaagaaaccttactgattttcagaaataaaaaactgaatatcagtaaggtttttcttttctattatttctttttcttatcaagtaatccctgtacaaggtagtcgctcaattcctgagatggtaccttggcacgtttctggtaagtatccagttccgggtacttatatctccattcatcatattcttctttgctgatttcaccgtttttcagtttgtcagcctgttccatccatgaacgaagcatttcatcgacagaggagccgggagtagatatggaagagtcaaggcagagatgaggctgctcatctacattttttacctttagaccatacatatcttccagtgcaaatagtgtatgcatcagacctatgtgagtatcaatatctggaactgttaaggcatgagtattgatatcaaagatctgagacatttgttttacaagatcaatcttaggaactctggcttcagattcatactgagccatgcggacatctgaggtttttcccatgaatcccaggtgttctccgagttgcttttgtgtcatgccgatgcggttacgaaaatatttgatacgttgtccgattgccattcttgtttgcctccttatagtggtcatttgtgttgccgtaattaattgtgatagaaaataaaacaattctgtttaggttcagtatagcatgagcaatttcggatagcaagaagaacttaaacaaaaaaatttaatattctcataaaatctcttgacttaaattaaaatgtttagtatcatgcaaatgtaacaacctaaacaaaatacgttaagatagaaaggagagatgcgatgtgacgaacagaacttttatgacagtagaagaagttgcagcggaactgggtgtttccaagtcttatgcttataagattgtcaaacagctaaatgaagaattacagaagctgggttatcttacggtagctggcagagtaaacaccaattatttccgcaaaaaagtatgttacagcgaaatgtaagagaaagagaggagaatttgtatgagtattcataaagataatgccactggaaagtggcgagtagtctatcgttataccgattggacaggagaaacgcaccagtcatcaaaaagaggatttcctacaaaacgagaagcacagatgtgggaacgagagctattgctgaagaaagaagccaaactggatatgactttcgaaagcttttatgagatttatgtggaggatatgcaaaatcgaattcgtgataatacctggggaacgaaaacaaatattgccagaactaaaattcttccttatttcggaaagcgtaaaataggagaaattgagccaagggacattattgcatggcagaatgaattgcttgcgatccggcagccaaatggaaagccgtattccgcctcttatctgcagaaaattcacagtcagttaagtgctattttcaaccatgcagttaatttttaccatcttccatctaatccagcacagaaagcaggaaatatgggaaaagaggaacaccgggaaatgctgttctggacaaaagaagaatatttgaaatttgcagatgccatgatggacaagcctgtttcctattatgcgtttgaaatactttactggtgtgggcttcgcatgggcgaattattagcacttacaccggcagatttcaattttgaaacgcatacactacggattaacaagtcctaccagaggttgcaccgggaagatgtgattacaccaccaaagacattaaaaagtaatcgaaccattaagataccgcagtttttgtgtgatgagatgcaggattatctgaaaatgctgtatgagccgaaagaggacgaacggattttcacgatttccaaatcttatctgcatcatgaaatgaacagaggatcaaaagtgtctggggtgaagcgaatccgtgtgcatgatttgagacattcccatgtatcgttattgatcaatatgggatttacggtattagcaattgcagatcgaatgggacatgagagcattgatatcacttaccgatatgcacatctgtttccaagtgagcagacacagatggcagaacagctggatattgaaaggatggaaaaattaaatggagaaaaatctggacagtaaaggaagatggagaaacaaaatcgtagcattccgggtatcaccggaagaagcagagcagattgatgcatgtgtccgattgtcaggacttagcaagcaggactatatcacaaaacgattaactgatcgggaaattgtggtacaggggaacccaagagtctataaagcattgcgaaatcagatggcagagatttatgaagaattgaaacatctggaaaaatgcagtgaggaaaacgaagagttgctgagtaccctgagattggttgcagagacattgtatggattgaaaggggatagtgaatgacagtaaaagaaaaaatgactgctccgattgcatctgttggcgcagatgtggaacagccattacaaaatttaaaaaccaaccaaagtatagcagatttgcccggtaagggcaatctgcaagccacaaataatgcggaaaatgcagcaaaatcagcaaataaaaagaatccagatgatctggaaatagtttctatgatggaattatacgataccgcatatccaccaaaactgccaattgtagatggacttctgtataacggaacttacctgtttgttggttcgccgaaaattggaaaatcattctttatggcacagatcgggtatcacatcagtaagggacttccattgtggggcttttcagtcagaaagggaacggttctgtatctggcattggaagatgattatgcaaggttgcaaaagcggttatcacagatgtttggaatggaaggcagtgagaatttctatttcgctacaaaatctaaatcgctcaatgacggactggaaaaacagcttgtaacgtttgtaacagagcataaagacgcaagattgattatcattgatactcttcagaaggttcgagaggtcggtggagataaattcagttatgccagcgattatgagattgtaacgaagctgaaagcattcagtgataaatatggtatctgttttctggttgtgcatcatacaaggaaaatggaatcttcagatagttttgatatgatttccggtacgaatggattgcttggagctgcggatggagcgttcgtcatgcagaaagaaaaacggacagataataaggcagttctggaagtggcagggcgtgaccagcaggatcagaaactatggttgaactttaaccgggagagatgtgtctgggaacttaccaagacagagacagaactttggaaagaaccagaagatccagtgttggaaaaaatcaaagagcttgtaacagaaactacgccagagtgggcaggaacagcaacagagctagtggaagtattgcaggtggaaatgcagccgaacgcattatcacgaaaattaaatgtcagcctggaacgattgattctggaatatggaatccagtataaaacagaacgaggacatgatggaagaaagatcagattagcctttgttggaaaacaagcgtgacgatatgtgacggttgtgacggtattttatatagcgtgacggtagtgaaaatatcgtcactatcgtcacgaccgtcacggaaaggagaaacatggaaagaaaatcacaggtacagatacccaaagatttattactggcattgttccagtatcatcttgccgggaacgaggaatatctgccggagatagaaaaagcattgatggaaaaattagacagtatggtaaaacgtcagttatatacaacattcaaaacagcaccaaccgaggaagaacgggaaaaggcaagacaagagtacttggataagtgtggaatgcatgaggactttcgttggtaaggattctgcttgatgaccttatgacaggagcgtgccacgcacctgtagatagcagacaaggagaagtccggaatgcgaagccgaaagtgtgttggaaatccggaaaatgacggatgctttgcaggtggcaaagggggccctgaaacggggctcccttagagaaaaatgatgaataaaggagaacgatgtaatgagagaaggaagattaggatataactgtgaaaatgacagatatggattactgtcgatggacttatggattgatacaggatttcactgtggggaatgcctggaagtactggtggatgaccagtggttacagacaagaatggaaatgaatctggcgagagaatggtatctggtaggaacgccatattgcggagatctggaatgtatccgggcaagaatactagattaaatctaacagggaaatagaagaaaacgaaatagataatctgtggtcagaaagaaaagtagcccggatacgggcataaaaactgggcggatacgcccaagatgaaaagcataagccggacagtaattgttacaggcagcatttatcaaagccctcggcgtttgagagcgaaatacacccatcgcacaaaactgcgttttatgctcaagggtatttcgccctgccgggagctgattatgccggacacggcaataagttcgtaaacggatgcctgagcatccactcacaaaaaatatggcagaatttactttgctgaaaaaaggagggagtgcctatcgcaagaaattcatttatccaattgacgaaattaagtaatgtaaaaggtcggatcacttatatatccagccatgcaaaacaggaaaatctttatgcagtctatgagactacggagcgaaaattctggcgggaacttgcaaaatgtaatcaggaagagtttgcaaaaagtggaacagaagggaaatgtattgaagcacgagaactgattattgctttaccagagagttttgtggaatatccgccagatagattgttgaaactgtttacagagcatttcaaacagaactatggaacggaatgcattgcagcattgcaccacaataagaggaaaacgaattatcatattcatctgatttttgcagaacgaaaactgttggctgaaccaatcattaagattgccagccggaatatgttttatgatgaaaatgggaaacatgtccgtaccaagaaagaaatattaggagaagacggaaaaatccgggaaggctgccatgtcgtgaagaagggcgagatttatgagaagaagttgtttacagttaaggatgaacggtttaaaagcaattcttttctggatgaagtgaagcgttcctatacggacctgatcaacctttatgtgaaagatgaaaaacagaagctgcaagtatttcaacgtggcagtgtttatcttgcaacaaagaaaatcggaaaacgtaatcccaaggctccagaaatcgaagcggataatcgaaaacgccaggaatggaatcgggcagttgacatggcactgatcagcggaattccagaaccgcagattatggaagtgaaacaaaaaagaatttcagagccaatcaagagtgcaatttcccggaaaggaagaaaaccaaacttatttgcaaaagttgttacgatggcgattgaggcattggaactgatgatagaaagcgtacttgtgaaaaagtataaggaatcattggaacagaaagaagaattacagaaaacagatgcttctgaaatgcagactggaatgccagaaacagagcgaacagaagcagaaattaacgagccagtggaaagattgccagaaccgaaacagccagaaatgacaagaatggcatcaaaatatccgagattttataagatttacaatgaactggaacagcagaacaatgcaatttataagaaagagaaacaacgttctgccaagaaaaaagaattgtctgagatcaaaggctggtttaaaggaagaaagaaaaaagaattgcaggaagaaatcgacgatatggcaagccagatccggaatatgaaagattatcttccgaagatcgtacagaaagttggttatagaagcatacaggaatttctgaaagacttcaaaactgcaaagtttgagcacagtcagtatcagaaggcaatcgcacagtggcaacaagaaacaggaaaagagccagagccacagccacatggtgtcagggcaaagttggcagcaaacagaaagaaaatagaacaggaacagaaaaacacgcagcgtacccgaagccagaatcaggatcgaggggtgagataggaggaaaaaatcatggagaaacacattatgggagaaaatggaatcagctatactttgggagcggatggtctgtattatccagacctgtatctcccggaggagacggagtatccgattggaaaatatggaatgttgcggaagacgtatttaaaggagcatcggaaaggggtgtatctggagctggtactagccgggaaactgaatgcgcatttgcaccagattgacgaggaatgccatcagatgatggacgggttggtggaacagatgaaagaacagcagggagtgacagaagaattgaagatgcaggatcagatggcatgggttgggagaatgaataatattcgggcttgtgcggaggagattgtgatgaagaaggttatatatacaaattaaaatgataggggaaggtcttttttagtccttccttttaaaatactattaaatactattaaatcatagaacgtatggttgctttttgagggaatataagttagaatgggaatagtttaattatgcaagatatatagggtggaggaaaaatgactgatttggtagataaatggtgtagcttagaagaaacagcagagtacttaggagtaacaaaggatacaattagaaattggattaaaaaaacagatataccggcacataaaattggaagactttggaaatttaagctaacggaagtagatgaatgggtaaaaagcggtaaaagtgccttgtaaatttgaaatgtaagtggggatgtaaatatgaacaaagaaagattatcaagattaataacccagtatcaaaagaaccttgaattttatagaaatgcaagagaatttaatgagcaagattgccgagatgaatttataagtccattattagagagttttggatgggatgtacataatgagaagggaacatcaccacaatacaaagaagtggttgtggaaaaattttcaaatagtggggatagaccggactatacattaaccttaaatggagtatcaaaaatttttgttgaagcgaagaagccggcagtgaatataaaagaagaatctgaacctgcaattcaggcaagacgttatggatggaatgcaaaacataaattatccatattaacaaattttgaggatatgatgatttatgacgttacaaataaaccgcaagatggagacgcagcaacggtgtcgctgtatcggaaatatcattatttagagtatttaaaaaagtatgaagaaatatatgaattgatttcaagagaaagcgtttatactggaaaatacgatgaatatgttgaagaaaaatttccaagtgaagatcgatattcaacagaagtagatgaagtctttttaaaacaaattaatgagtggagattggaaattggtgactatctgtaccatatggatagtacttatagagatatagagtttttgaacgatgcggttcaggagtttataaatcaaattatctttttgagaatttgtgaagacaggaacttgcctttatatcaaagtttaaaagaaacagctcagaacaaggtggaattacaagatgcactgacaaaagtatttaaggaagttgataaaaaatataattctaagttgtttgcgggtgataatattatttttgatctaaataatgaaattatttttaatatgattctttcattgtattatcctaagactccctatatgttcaatattattgaaccaggaattttaggaaaaatatatgagagttttttaacagaaagccttattgaaagagaaaaccatataatacttgctgcgaagaaagaatataagtatcgatcagtagtatcgactcctgtcgaaattgtaaagtatatggtaaagaacacgttaacaccaatttgtgaagaaaaaacaccagacgaaataaagaaaattcagattgctgatattgcatgtggatctggaatatttttggaggaagcatatcaatttttagttgattattgtacagaatggtatatgcaaaatgatccagagcatttattagaattgagcaatgggaaaaagaagctgccattgactgataaaaaagatattttaacgaaatgtatttatggtgtagatattgatgtacatgctgttgaagttagtaaattttcgttactgataaaattaatagaggatgaaacaccggcatctgtgaaagaatgtgttccgattttaccggatttaagttctaatataaaaaatggaaattcattgatctgtagagaagatattcatggtaaagaattgccaatagaagtgttgtgtaacataaaaccatttgaatgggaaacgattaatggaggagctaaatttgatgctattgttggcaatccaccatatgtaaaaactgaggatatacacacattagagacagaggaagaatttgcagtttataaaaagaaatataaaagtgcatataaacagtttgataagtattttttatttcttgaaaaagcatttgatctcttaaaagaagacggtcagatgtgttatatcgtaccaaacaaattttataaaataggagcagggcaagaactacgtcgcataacagctaaatatgtgtcaaaattggatgattttggagatatgcaacttttcccggataaaactatttatagttgcattattacactatgtaaagaatgtaataaacagctgcaatatacgaatgttatttcgttaactgatctctggactggtgaagaacaagaaaatattgaaattaagaatgaaatgttggacgaaaatccatggagattaactacagatattaaatttatgaaaatgatcgccaaggtagaagaacatggcaaaccattaggagaaatagtaaatatttttaacggaattcaaacaagtgcagaaagacctaagccggtgtattggtttagtaaagatgaaattgtttcggaaaaagaagacgaaataattgttgataagtttgaaaaaagatatcatatagaaaaaagcattttaaagcctttctttaaacctactaaggcagatgaaaaaggaatgggaacttattcaatattaaaaacagataaacatattatttttccgtataatgcagatggtagtctgattagcattgacgttatgaaaaaagaatatccaggaacatatcaatatttggaagattgttatgagttattggtgcctaaatgcttaaatggtggaaaaggccgagatattaaaaatgcaacagcggatacatggtatcagtatggaagaactcaagcaataactgcgtttgtgaatactccaaagttgattgtaagaattttgagtaaagatcccatgtatgcatacgatgaaaataatatgcttattgcttctggaggaacagcaggatattgtgctatatcaaaactgcctgattcaaaatatgatttacgatatatacaagcatggttgaatcatccgtatactgaaaaactatttcaaattatgggaagtgattttgaaggaggatttacagcaaggggaacatatctgctgaaaaagataccttttgttgagttggattttaatgacaaaatacaaaaggcattgtatgaatctgtacttgtttctgtaaagagaattagagaattgaataatgtgttagagcagaagaaagataaagcctccgttggtgtaattgaagcggaaaaagagaatttaagtaaacgaattgaagatgatattacaaaaatttataatttgcaattttaggtgagagaatgatattaaaagaggatagttcagaacaaaaattaagaggtgcttattatacaccgttaaaattagccaaaaagatggttgatttttttaaggatgatttatctataaaatccatattagaaccaagctgtggtgatggagtatttgtagatgcattactagaaagtcaatttttatcgcagcataaaagggtaaccgctatagaaatcgaaaaaaaagaagcggaaaaattaagtgaaaagttgaaggataattcgaatatagatgttgtgaacggagatttttttgagttctatcataaacataaagatatggacacatatgatttgatattaggaaacccaccatatattcgctatcaatatctggaagaaaaacaaagatctgaaatggctgaaatcttaacaagtcatgggatgaaagcgaataaattaattaatacttgggttggatttatggttgcttgtgttcatatgttgagcgataatgggaaaatcgcatttgtgattccggcagaaattttacaagttgcatatgcggaggatttgaggttatttttatctaataaattgtccaaaataacattgttaacatttgaagagctagtttttccaggaattgaacaggaagtggtagtttttattggagagaagggagattcggaaaaaggtataaaaattgtagagctaaataatcttgaagatttagaaaatcttaatatatatgaaaatggttttcagaaactcaatcatgtgcatgaaaaatggacaaagtattttacaactatacaagaaaaccaattgatttcagatttaaaaagagataatagattccaaacattgtctgaaacgggcattattaatgtaggaattacaaccggaaataataagtatttttcagtaaataaaaaaattgttgaaaaatatgatttaacagatgttgtacgaccactaataggaagaagttctcatgctcatagtgtctatttcaaagaggaagattggaaagaaaatgtagatcaaggaaaatcagcatatttgatagattttccagatacattgcttgagaaatatagtcgagggcaaaaagattatattgaatttggagagaaaaatggtgagaacacaggatataaatgtaaaatcagagaaaaatggtatcaaataccgtcggtatgggtaccggatgcttttttcttgcgtagaaataacttgtatcctaaatttgtattgaattgttgtgctgctgtttctactgatactatgcataggataaaatttaaagaaggtattgagccagagagaataattttatcgtattataatagtatttcctttgcgtttactgaaatatgtggacgcagttatggtggtggagtactggaaatattgcctggagaagtgggaaaggttttggttcctgttttagattgtgttccacttgaaaaggtcagagaagtgttgcatcaagtagatcagattgttcgtaatggggagaacattgagaaggcattagatattgtggataatggtattttgaaagagtatttaggtattgatgagaaaatgtgttctatgtcgagaggaatatggaagaagatgcagcatagaagattgaaaaggggatagaatggcagattttaaatatataatgcaggggtttcaaaaagatataaatttttttgatgaaataaaagaagtacttgaaacagaagattatacatccatttggatattgacagcatttgttaatgaacgtgctatatgtaatcttatgccaagcattaagaaatcaaaagcggatatttcatttattataggaataagaaacaatgtatcaacatatcaggctttaaaatgtttaataaatatgaaggtgagcgtatttgtatttgatacggcgagaatagaatccatttttcatgctaaagtaattgtgggaagtgggacaaattctgcaaaagttatatgcggaagtgcaaatataactacaggtggtctggctaataatatagaggctggaattattagcaaactaaatttaagatgtgaatcagatgaaaaatttttaacagaagtaagagaatatattgataacataattcataattatccccaaaatgtgaagaagatttcagaagatagagaacttgatgaattgtatgagcaaggacttgttgtagatgaaaatcaaagaaagcttaggaataattttttttgtgcaagcaaggaaaaacaagaaaagtctatagtttcacgatttccattagtaaataaaaaattattaaattttggaaaaaaacagaaacaaacaaatgccatactgagaaaattagatcaggttattgttgaagaagtatgtgaagaagtttggaagagcaataaattgacaaaatcgcatttgggaattgtgaaaaaaggtacacatgcaaaaggtgaaatgagtttaggaaaaggtcaatatagacaaattgatcaatttacttacttccgagatacagtttttcgagatttagactggaaaaataataaaagtggagatgaaatagcaaacgcatattttaccatgataatatgcgggattaattatggagagtacaaattaagaatattgcataagcgaaagggaatggtagcatatcagcagaataattatgtaacaagtattcgatggggggatgtttcgcatttgttaaaaaatgaaaatttgcttggaagagaattggtaatatataaaacatctgataaagaacgttatgtaattgacattgagtgaaaagtttataaaaagaaaaattaaatatcgctttattgcagtatggaaaggatgaagcatgaaaaatacaagaggatctgaatggaataaatgggatttacatattcatacggcgtcatcatatgacagcccgtataaagcagacgatgcagatgaattattatgtcaagcattagcagaaaatgatataaaagcagttgctattacggatcattttaaaatagacaaaacaagaatagaacacttaagaaaacttgcaccggaaattgtgttctttcctggggtagagctgcgaactgacaaaggagcaaataatttacatctgattcttatcttttcagaactatcagatttagagactttatcagcagattttaacgcaataatgttacgaacattggctaaatcaaaggagtcagatgaaactatttattggcagtttgacgatattgtggagttttgtaaaaatcatggaggattaatttctattcacgcagggaagaaatcaaatggtattgataaagagatttcaaatgcattaccggtaaaagaggcaattaaatcagatattgctaagcatgttgatttttttgaagtgggaaagaagaaagatatagtagattattataaatatgtttttaaggaaattgatgaaaaaccaattattttatgttctgattgccatgatccaagaaagtatagtgcaaaggaatacctttaaggttgagccgtccctgatgaccgtctttgaacagagtcatacgtgggatgaattgatccggcattttgtggattcctatgttgtggagaaagataagaaggcggtatcctctttttacgaccgtggttatattgcagaaaggctgaagggtctggaaaccgaattggctttagagtgccgtatcattctgaatggagaagaacgatgggtccgcaatgtggtcatacgtggcgaaatagaggattcagaatatgccatgatctttctgcgtgatatcacagaggcaaaggtggagagtgcgcggcatctgcagatggcagcggataatgcttccatggagcagctgattcagagtattgtgcgtctggttgaccgctttgttgtctgtgatctggaaaatgacagatatgaattctacaatctgaatggacagatgctatataaacctctgggattttatcatgattttcagatgcaggttcttgaaaaatataagacactggaaccattggaagctatagatatcctgatagccccggataatattcggaaaaaactgaaaagtgaaaatgatatttataagtttgagtattgcagccgggatgaaaagacttataaaatcgcttcttatattcccttggaatggaagaatggaaagctggaaaaggtattgctggcatccatggatgtgacacaggagaagaaagcagagattgaatcccgtcaggcactgaaagaggcttaccggtccgcagaaaatgcaaatcgtgcgaaaacagaattcctttccaatatgtcccatgatatccggacaccaatgaatgccattgtgggtctgacggcaatcgcaggagcaaatattgagagtcaggacagagttattgaatgtctcagcaagattacagaatcaagccgtcatctgctgggactgatcaatgaagtgctggatatggcacgtatcgaaagcggaaaaatgacgctggcacaggaagatttcaatctgtcagatctggtagataatcttattacacttacgaaaccggtgcttgatgaacataaacataattttgatatacacatcaatcatattgaacatgaggctgtctgtggtgacagcttgaggattcagcaggtatttgtgaatctgatgagtaatgcgatcaagtatacaccggatggtggaaatattactttttcgatagaggaaaagtccaatggattttcagaacttggatgctatgaatttacgattgaggataatgggatcggtatgtcaccggaattccagaaaatcatgtttgatcctttcagccgtgcagatgaccaccggacaaccagagttcagggaaccggtcttggaatggcaatcagcagaaatattgtgaacctgatgaatggtaatattaaagtggacagtaccttacataagggaaccagaattacggtaacaatttatctggagcttcaggaaaaagaaaaagaacaggacaaaaatctgatgaatctgccggttctggtagtggatgatgataagacatgctgtgaaagtacagttgccacactgaaggaaattggtattatgggtgaatgggttctctctggcagggaagcggttgagcgctgttatgcacggcatgagttgaaagatgattactttgctgttattttagactggaagatgccggagatggatggtatagaaactgccagacagattcggaagcggctaggtaaagaaatcaccatcattgtactgacatcttatgaattcagcgagattgaagaagaagcaaaggcggcgggaatagatgcttttattgcaaaaccgctgttccgttcccggctgacggctacactgcggcagtttacttcaggaagaaaagaaaaaacagcaagaaattatttggagaagctgtcagaatcagactacacgggaaaaaggattctgctggttgaggataatgagttgaacagagaaattgctggtgaaattttgcagatgacaggggcagaagtggaaacagcagaaaacggaaaaatcgcagttgaaaaagtggaagcttctccggaaggattgtatgatcttgtttttatggatatccaaatgcctgtcatgaatggttatgaggcaactgcagcaatcaggagccttcctggtgaaaatggaaaactgcctattgttgccatgactgccaatgcttttgcagaagatgtacagttggccaaaaatacaggcatgaatggacatatcgcgaaaccgctggatatgaataagctgaatgatgttctggaaaactggctgtaattgcttcacaattattgaattaatgattttatcaggaaagaatgaggaaaataagagtatgaaaaaggcaaaacattgtctgatagctttattgtcaggggtgcttgtagcagctactgttttgtctggctgtggacaatctaaaaaagcagtatctaaaaatgacgatcaccttaccgtgtatctgtgggaaaatcgtttaatgaaaaatattgtaccctatatccatgagcagtttccagatcaggatattgagtttattactggtaacaatgataccgatttatatagctattttgaggaacatggtgaactgccggatatcataaccgtacgtcgattttctggaaaagatgcacaggatctggagccatatctaatggattttgcttcttatgatgtagtttccaggtattactcctatgcattgcaatattataaaaattcaaaaaatgagattcagtggcttcctatctgcggtatgccgcagacgattattgccaacaagacattgtttgaacagtacggaatcaagataccgaaaaactataaggaatatgcacaggcgtgccagcaattttatgataatggtataaaaccatattccctggatcttgcagaagactggtctgctcatgaggtgattcaggcaggtgcaatcggtgaattcatgagtctggatggaatcgaatggagaagctcagctgaaagtgcatcaggggatattgcgtttgatgatgcgttatggaaacgtattttttcagaaaccaatacatttttgaaggactcacattttacaagtgatgatatcagcgtcgatattaatactgcagcgcagatgttccttgagggaaaagcagcaatgtttcatggttatccggcacttatgcaggaatatcaggaacagatggatgcagaattaacccgtataccgtttttttcacagatttcggatgaagcttttataaatatgaccccttctctgaatattgcattcaacaaagacctggaaaaggatcaggaaaaactggatctggcattcgatgtcctagagtgtatgatttcaaaagaaggacaaacgctgatcgcagatggaaagggtgtaatttcattaaatgtagatgttccaaacatgatggaagatatacctggccttgaagatgaaattaataataattctgtttatatccgatattctgctcaaaaatcatttgatgccagccttaaggctgttcacggattattgtcaggggaaatggatgaaacacaggcttatgatgcttttcgcagcacaatgaacagcaaggattcaaaagaagaaaccacagttaattttgaaaacgaatatgccatttcgctaaatgataaaaacggtcgcgatgcggcatcttctattttaactacgatcagagaagaaaatgatgcgcagctggctctagtgccatattattattttacttcttccatttacaaaggggagtgcaccggcagccgagttgctttgatgacggcaaagagttcagatacatttttatacctggcaaaaatcaatggcaaagaaatttatgaacttgcggagaaatatcttgctgagtccgatgagaaatttcacataaccaataaatacgaattgccagttgcatccggtatgaaaataatcgtcaggcaggaggaaaacggattctcattaaaggacatagaagtaaataagaaaaaaatagacaaagacaaggagtactctattcttcttacagaaaccacaatgtctgttttgaaaaaaataaatccggaatgtgagatcaggcagcttgggaacacaacattatcaagtgcatggaccgtagcaatggcaaacggacagcagccgtcagcaccggaagattatatagaggttgaaaaataaaagtgggaatagaacaagtaataacaaaaagaaaaaagatgataatgccattgttctttttgattcttatctttttaagcttaatttttgtaaagctccttttgaacaggatgaacagctatatcgcggaaaacgggaaaagcagtatgggagctgttgttgaacagatacagcagacctatgatctgcaggtgaatggatactacagccagctgcatttgcttgaggattctcttattcaagaggaagtgagatctattgaactggatagaaacaagaagttctttgaggcatggcagaaagaatctgaaagtacacttatatttctccaggaaaatggaaaggcaataaccactgatggaacaaaacttcgggttgacatgccaagtaaatgtttgttggatttgaggaacggatataatattggaaaattggtttctcttgattacaaccagaagaaaaaagatggttatctggttgcaattccatgtcaggaatatacgattaatggggaaacttatacggcaattggaaccttgtatgatcattcaaaattagattccatgttaagtgtgaaaagctataacgggaatgcgtatctgtttatgctggataacgacggaaatattacttatacaaatcagatagaagataaattttttaggaactattttttgttaaagcatttaaaaggagatcaggctatcactgagaaagaggctgattctcttcaaaaaaagctggatggcagagaacagggggtagaacttctgggaagtgacaaaccttactatctgggatactgtccgatagaaaataataacaccatgctgatctgtattgtagaaaagagtgttgtagataatgtactgaaagattatcagaaaacaatagtgtttgaaacaatactcatggcaggttttatacttttgctttttgccggattattctgcagtatttctagacgcagtcttgctgagcaaaaagctgaatatgaaaaaagaaataatgagattcagacgcaggcaatgaaggaaatggaggagtccaataaaaaactgaaaaaagcaaaggacattacaacggaagccttgcagaccgctgaaaatgcaaataaggcgaaaacagatttcctgtccaatatgtcacatgatattcgtacaccaatgaatgcaattatcggcatgacatcattgatcagacatgatgccggtaataaagcgaaagtaatagagtatgcagataaaatagacatttcatcacagcatctgttaggaatcattaatgatgttctggatatgagcaaaattgaggcaggaaaaacagtttttaagtataccgatttttccatcttggattttattacagaactcaataccatattccattcacagatagacgaaaaaaatcagactcttacaatcataaaagaaaacatccggcacgagtgggtgaacggagatcaggttcatctgatgcagattttcagcaacttggtttctaatgcagtgaagtacacgcaggaaggtggaaaaattcagtttctggtagaagaatgtgagacaaagtcatctgtctacgcaaagtatcgtttcttagtcagcgataatggcatgggaatgtcggcagatttcaaagatacaatttttgatgcttttactcgtgctgaaagttctatgacgaataagatacagggaactggtcttggaatggctattaccaaaaatctggttgaagcaatgggaggcagcattgatgtggagagtgaactgagccagggaagctgttttgaggttcttatagatctgagaatagcagaagatagatttgtttcttcagcagaacaggcagaaaaggatgaaccggctggcaatgtcctgaaaggaatgaggtttctgtgtgcagaggacaatgagctgaatgcagaaatcctgatggaattgttaaagattgagggtgcagagtgtacaatctgtgaaaatggtaaaagggtcttagaggcatttgagcagtctgctccgggggattatgacatgatcctgatggatgtgcagatgccggttatgaatggttatgaggcaacaaaagcaatccgaagaagctcccatgaactggcaatgacaattccgatcattgctatgaccgccaatgcgttttctgaggatattcagcattctctggcagccggtatgaatgcccatgtttcaaaaccggttgagatgaaggtattggaaaagacgatcagaagcataaaatccggcgggggacatcgaaatgcaggttattgaacagtgataaatggaaagtaaaaagtggagattgctcccaaaggcttgatgtatttctacagaatacaggatgtgcgatggcagctggcacaggatgctttttattgtaaaaaacgggatgagtctggaaatgtaacccatgttttatgtacagtccgtagtgttagcgattccaagagatgtgaagagaatcttaactttgcagcggaagcagcaaagcgggaagctgaaatgaaaacaaggtttctggcaacgatgagtcaggatattattaataatcgttttttggaagagtcggtatttgctattgccgatggatactgcgtgatcaatctcacaaagaatatcgtacgtggttccatgtatcaggtaattaatggaaaaaaatataacctgaatgaacaattaggtttgccggaaaataattgaaaacataaagagaattttgtgtgaatattgtgtgtagtggttgcaatttctcaaatccgtatacctatttttcacgttctgtaggatattataacgtaaatgtaaaactggcaggtatttttgctgaataagacagcaaatcctaaaatgaattcttaaaagaattatattgttatatgatttcgtaagtgatatacttaaacataaggaaaaccgtgtgaaattacagtttgctttttgcacggtttcttttacacatgatagttagttaaaactaacaatggaacgatgtgaaagtacttttgactatacagaaaggaatacataatgctaatgaatgtttttgaaggtatactgattccatttgttggaacaacgctaggtgcagcatgcgtgttttttatgagaaaaacacttagcaagttactgcaacgtgcacttgcagggtttgcagcaggtataatggttgctgcttcaatctggagtcttctgattccggcaattaaacaatctgagaatatgggaactttatcgtttgttccggcagttgttgggttctggattggtatattgtttttactcgcacttgatcatttgattccgcatcttcatgttggaagtgatcaggcagagggaccgaaaagcaaacttggccgtactacgatgatggtgttggcagttacattacataatatccctgaaggtatggcagttggtgtaatgtatgcaggatttcttgctgaaaatgcacagattacagcaacaagtgcacttgctttatcacttggaattgctatccagaattttccagaaggagcgattatatccatgccgcttagggcagagggtgaaagtaagagaaaggcatttctgggaggtgtactttcaggagttgttgaaccgattggagcagtaatgacgattcttgtcgcacagctggtaatcccggtattaccatatttactcagctttgcagcaggagctatgttatatgtcgtggttgaagaactaattccggaaatgtctcagggacagcactcgaatatcggtacgcttttctttgcacttggatttagtttgatgatgatcttggatgtggcactggggtaagaggaatgattcttatgagaatattgatttatggtgctggtgtgattggagaaaaaagcatgaaaaatgaagaatataaaaaaatatcaattaaagagtttacaaaagcagcagaaagatatgaaagtaaccatgctggcatttacgaaatgtgcaagaaggattatccggatattctggaagaattagagaaggagccatttagagatttattagatgcaggctgtgggcctgctccgatgatttctttattagcagaaaaatatccagaccggcattatacaggactggatctgactcctgccatgattgaacaggcaaaaaagaaaaatattccaaatacaacatttgttgtaggagactgtgagaactttccttttgaaaaggattcatttgatgcaattatttgttctatgagtttccatcattatccggatccacaggctttttttgacagtgtgaaaagatgtcttcgcccaaatggaagattgatactgagagatgtgacgagtgacaataaagtattggtatggctaatgaatacattggaaatgccgttggcaaatatatgcggacatggagatgtccaagtgccaacaagagatgtggtcataaaatgttgcaaaaaagcaggattaaaagtagaaaaatttgaaattcgtaaaggtatgcgaatgcattgtgttgtgagaaaacctatgggaaaggcgataggaaatgaaagataagtatcttagggaaacacgaatggttgatttttctaatccggcaattcaaaaacttattcaaaatatgaaatggaaggaaatgggtgaatttgaaaggattaaggcaatctacaactatgtaagagatgatgttttatttggatataatattgatgacggaatttcagcttcaaaagtacttgcagatggttatggacaatgtaatacaaaaggaactttatttatggcacttttacgtgcctgcaatattccatgcagagtacatggctttacgattgataaaagattgcagaaaggggctatgaccgggtttgtttatcgtaatgctccaaaaagtattttccatagctgggtagaaattaatttcgaaaatcagtggtacgaactggaagctttcattttggataaaacctacataaagaagttacaggaacaaaattcggaatgtacaggtgcattttgcggttatggagtagcagtcaaggatttcagaaatctcattattgagtttgataggaacaatacttatattcagagcgagggaatcaatcaggattttggtgtttatgattgtccagatgaactgttgaaggaacatcatcaagaaatttcagcctttaaagcatttgcttatagacatattggaagacacctcatgaatcgtaatgtcaggaagattagagaacgatagttttaagcttttagaattaaaattaaatttggagggtaatatggcagacaaaatacaaaatgcttatgaaacatcaaaaaatatatatgacgatgttcttacgcaaagaaatattttcagcaaactgtatattaagttattttggagtggcactgacgataatgatatagcacgaaaaggtttatcatatgttcctgatgacttttcaggaaatcttcttgatgttccggttggaactgctgtatttacggaaaacaaatggatttctctgaaaactgcacatattacttgtattgattacagcatggatatgcttgaacaagccagaaaaagacttggtagtcatgcgcatatcaaatgtattcagggggatgtggggaacctgcaaatggagaatgaatctgttgatactgttgtcagtatgaatggttttcatgcatttcctgataagcaaaaagcatttcatgaaatatggcgtgttttgaaaccaggcggcgattacattgcctgtttttatatcaggggaaaatcgaaacggacagattggctggtaaaaaatattcttgcaaagaaagggtggttttctccaccgtttcagacggagaaagagctgagagatatccttcaaaaactatataaagaaacggatatccatgttgacggttctatggtatatttccgttgtgtgaagtaatgcaatgatgctggatttataataaagtttcagatgtgtgaaaggagaagaaatttgaatgtaaatgaaattgcaagtcttggaagtaatgtgaagcctgtgattcagaatgagaattgaagaatgacagaaaaatatgccttactcttttacactataaaaatcgtaagcttttccgcatccacatggatatcacatatagcagcctatcacatattggagggtttaaggctccgcctgacagaccggtttctgaaagcaccattaggagatgtggaagggcacagtattggtgaaatcaagagcattatggtagaaaaaatcgaaaatatggaaccacccattgctcatatgattccggaaggaagcggacatatcctgcttccggtaatcagctttatcgctttgcttacgctggactggagaattgcacggacttctcttgtaaccgttccattgtccttggtatttatgacacttaccatgattatcagcggaaaaagtttcactcagtacgatgaatccaatgcacatatgaacagtactattgtggaatacatagagggcatagaggttattaaggcatttggcagggtaggaacctcttatgagaaatatgcaaaagcaattttggattataagaaattcgttgtgaaatggctgtcttctatctggatcaccatgaaaatgacattcgccctgtttccatcgacactgcttggaactttgcctgtgggactgtatctgacgatgcatggtcagttgaccatattggatgtaaattgactttgttcgtatttggaattataatttaaagatagaaatataattgatcgtgaattcactataatatggagatgaaagcatggaatatctttcaatcagtcaaacagttgaaaaatggggactgtcgaaacgacgagtgcaggtactttgctctgaaaataggattcctggggtaatgcgtgtcggcagctattgggcaattccggcagatgagatgatgggaagttgataggatattatgagaaacatggatatcgaaattcagagactatgaaacaatacgatttatggtgatgatatgacgaaggatgaatggtacaagcagttatttgagcgactggacaattccaagttccgaagcagtttccatctaaagcagaaagatattgattacataaacgaaaaaggactggagagaatcagacaacatgcagaggattttatctcaaaaagagaagctccggcatatatagcaaatgatggcaagcagacaccaatgcgtggtcacccggtatttattgcccagcatgcaactgcaacatgttgcagagagtgcatccggaagtggcataaaatgcaaccgggaaaagaactaagccaagtgcagcaggaatatcttgtagatgtaattatgacatggattcaaaaagaaatggagaggcactagtgcagatatttgtagatgcagatgcatgtccggtagtaggtattatcgagacaatagcagagaaatataatattccaactacattgctgtgtgatacgaatcatattttgtattctaattatagcaaagtgattgtagtaggggcaggagcagatgcagtagattataaactgatcagtatctgccataaaggagatattgtcgtatcacaggactatggtgtagctgcaatggcactgggaaaaggtgcatatgccattcatcaatcgggtaaatggtacacgaataacaatattgatcagatgctcatggaacgtcatttgaataaaaaagccagaagaagttcccataagaatcatatcaagggaccgaaaaaacgaacagaagaagatgatgtaaggtttgcacagtcttttgaaaaaatgctcatgatggtacaggagaaatttcaaaagaatactaaaacaatggagacaggggagatgcagttatgagaacattaggaaatattctctggtttatatttggaggagtgttaggtggactggcatggatttttgcgggatgcatatggtgtattacgattattggaatcccagtgggactgcaatgtttcaaatttgcatctctagcattctggccttttggaaaagaaattgtatatgaaaatggaatgttctcatttttggtgaatttaatttggatcctgttctttggctgggaaatggcattggggaatctgataattggttttctttggtgcattacgattgttggaattccatttgggaagcagttttttaaaatggcaagactttctttcatgccatttggtgcaagtatgatagggtagagcaataaaacagattagatggaaaagcaagaggcaccgttaagtaggtacctcttcttttgtgcaccttgcggcgcacgtttcgaatgggtgaaagtccctaatccgccctagtagacagcttaacaaacaactgaaaattggaggtatattgatcacaatggtggataaccgaacgaactatgtaagagatatatctgatttgattcttgatacatatggaaaccagattaagatttttccacaaagtattccattttcagtacgagcagctgagatcagtgcagaagaaatcagcatatttgagcatgatccaaaaggaaaagtagcggctcatattggcagatgacacaggaggtgcttttagatgaaaggtaaaagtgcatcgaagataaaactgacatcctatgatgaattagttggtggaggagaagaaacgaacgatatccaacaggttgcacttgagcatttacattctttcgagaaccatccatttcaagaataattatatcgtaggagatactgataatttccgttatttggaagaggaagacagataagaatacgaacatggtaaaacctactattcaccagtcagtttaaatattgatttgatcttaagtgatgaacagttaaaaaatggttgggatactgattatttgggtatgtatgaaagtatggaagaatatcagtcagcgcaaggatataaggttaatctgatacaagataataatggtgacgagaaattaaatgagggagttgtttcagaaaaaattgcagtatttgtttcaaacggaataagatatacgttaaaagggcgtgtatcagttgatacaatgaaataaatttattaaatattctaaaatgtgaagagggtatatctgctgaaatggatataccttctttttgggtaattaagttgaggctaaaggatggactgaatctaaaaagtacagtaaaatctacattagaaatgttatcgggaaatattcgtggaggggaactaaaggatgaagaatgaaattgtattatttacagatggtgatgttaatatagaagttcaaatcaatcctgagcaggagacagtttggctgacgcaaaaacaaatggaagtgttgtttgatgttaagcacgctacagtaagcgaacatatttcaaatattcttgtttcaggagaactggatgagacttctgtcggtttttccgacagaagtacagggggacgaaaacccaaaatttataatttggatatgattttgtctgtcggatatcgagttaattctaaaagaggtatagctttcagaaaatgggcaaataatgttcttaaacagtttattttgaaaggctatgcaatcaatgaaaagcgtcttcaggcgcttaagaaaacagttgatattcagtcaaggatgcttgcagatgcacttgatatagaggagaaagatgtgctcagagctgtgaatgaatacacagatgcattgattcttctggatcaatatgaccaccaggcattaagtaagccaaagggaagtactccagtataccgcattacttatgaagagtgtgttcagatggttggtcagatgaaggattcttttgaaacagatgtatttggtgtagaaaaagaggctggtaaggtacaaggaattattgccgcagtttaccagagtgtattcggacaggatgcgtatccatccttggaagagaaagcggcgaatctattgtattttatgataaaagatcatccatatgcagatggttgtaaaagaattgccgcatcactgttcttggaatttttagacaagaacaatgcgttgttcttggatggagagaagagactcagtgatggaacgttagtagcaattacattgatgattgcagaatcaaaaccagaagaaaaagatgtgatggtaaaactgataatgaatctattgaaattatagtggcattgcatcgcttttatattacaacagtatataatgagatgaactaaccttgtgcccactgggcacgaagttggttcagtcactatggtgtcaggagaaatcctgtagcaagtggggaatggttcgactccattcctcattttttcgtgcagaaaaactattcatgataatattttgtctttccaccaagaagaatttgtgcaaaatgaatttacagacagagacgagcttcgatgtttcttgctggcagtgtctggaatatataggatacagtaataaaaactgtaaagttgtatatgaatccgctatataagctctttattttatctggcaaactcggcttaaaaaatcatattctaccttcgaggggtatgcttttcttctcaaatagagtacgattaatataagaaggaggtgcgatggatggatcttatcaaaatcggaaaatacattgcaggcaagcgaaagtccctggggatgacacaaaagcaactggcagaaaaattaggtatgagtgataagtctgtttctaaatgggagcgaggagtttgccttccggatgtatctgtttataaagaactttgttcgattcttggtattagtctcaacgagtttctggcaggagaagatatagtccaagagaacatgattcagaagtcagaaacaaatattattgaagtgatccgagacaatataaataaacagaaatgcctgaaggttatgaaatgtatattattagttatagctatttgtgcagtatcaataatcggatttaccatataccgtttgaaaaaaccgcagaatttcattgcgcctcttgcagaggatagtatagaaatgcagacggcaaaactgcttgctggaccggatggagcattcatctacaagtttatcacaacggatgaatataaaaaactcagattacatattcaccgatatgaatcaggaagattaagtaatcaggacaaagttgaaataggatttgaagatattggttcaccaaaaagtggtgaaatcgtaatggtgcctgattttgacaattatgtaattaaactaattatttctggagatggtagtaagttgtcaaccgaaattcctattttagaaaatgtagaagatagagaatactatggtagatccgcaactgaaatacaaaatatcgtagatatccgatataataagcagcagccacttattgcctttctttatgatgatgaaacaatgagtgttccggctttagatgatcttgtaaatagccaaacagagtttatttcaaataacgattatgtgtattatgtggcatttgagttttgtaagtaatagacacatacatacggagaagtaatgacaataatggctctgaccagggggatatggagcaacgattattttgcggttagttctttgatttgcatggttatggctatttattcaggacataaaatgctttctgggaaaaagaaaaccaagaaagaattggcgaatgcagaaaatgaataatgaaccaaccttgtgcccactgggcacgaagttggcacagtcactatggtgtcaggagaaatcctggcatcttttttatgtctttttacactttaaaaaataatttaaaaaaatttctaaaatcatgtcctataaggtgaatgaccgtcagtatgattaatataatttcgtgatccacggttaggctttttgatatttttccttacaatgtttgggaatatggtatttcataaaaggcatatgtcaaaaatattattgacatatgccttttatagggctattatataagaaaagcgagaaaggagcagtttatgccgagaccagtaaaatgcagaaaagtctgtcattttccccaaattttagaattccttccggcaggtgatacggagaaaaaagcacccattgttctgacagtagatgagtatgagacaattcgtcttttggacaagaatggttatagtcaggagcagtgtgcagtatctatgcagattgcaagaacaacggttcaacgaatttatgagattgccaggaagaaaatagcagatgcactcattgatggacatccacttagaatcgagggtggagatttcagaatttgtgatggtcagagcagcaactgtagatttggaggctgttacaaacaggaaatttacaaaaaatatgcagaagaaaaaggagaaggtatcatgagaatagcagtaacatatgaaaatggacagattttccagcactttggacacacagagacatttaagatttacgatgtagaggagggaaaagtagtacattcagaagtagtagatacgaatggaaacggacatggcgcattggcaggagttcttaatgcattgaacgcagatgttttgatctgtggcggaatcggaggcggtgcacagacagcgttagcggcagccggtattaagcttttcggaggagtttccggagatgcggataaagcagtagaagcttttatcaatgaaacacttgattataatccggatgttaagtgttctcaccatgagcataaccacggggaaggacatacatgtggcgagcatggatgtggaagccatagctgtcattaagaagaatagcaataataatacgaaggatgtgctaaggtaatagagaagttaccgtagtgcatcctttttgtgttagtttccggaaagataatttgtattttaaggacaatagttaaagtttgtggatgttgtgccaaaccttatatattgattatttctttttttttacttgcgtactatgaacttaagaaaaaaatgttgacggaaagcaggaagatataatttggaagggagattatgatatactgtaaacaagatatagtgcaaaacgtaacagaaaggagtatgcacagtgtcagagaaaaagaagtttacagtatacgtcggaagtgtggcactatgcgtaggtgtggcagttctgctgcattatgtgtcatttaccaatccttatctgcaatctgtttgtcatcttttaagaccttttatttatataggactttatctggtatgggcggtttcttttcaaaaaaggattatccaaaaggaagccaggcgttgtttaataatgattgcagcgatgatagttttttggatgctcattcgtatgtgtaaatttgaaataccgtatgagatgccgacagcattgcgctatgcctggtatctttattatattcctatggtgttgctgaccacggtcagtctttatctggcattttatatacggcagccggagaattataaattaccggaaagacgatgtctgctgttttgtccggcattgtttctgatagggattgtattaacgaatgatctgcaccagttagtttttactttcccggaggggagactgggggaagcagcttcctatgaagtaggcgtctatggatatggagcaatgtattatgctatagtcgcctgggatcttggctgtctgctggcagcactcttgattattctattaagatgcagaaaaattaaaaacaggaaaatgctttggatgccttttggtgcttatggactgtcggttgtctatggcatcgcctattatctgaatctgcccttttggaaaatattttcaagcgatatgacagctgcattatgccttttgtttgctttgatcattgaaagctgcatccagtgtggattgatcccttccaatacaggatacgcacaattatttgcagcatctacaatttcagcacagattacagatcggagtggaaaatacatttatcaatcgcaggattcggaatatattgcgccggaaatcgtaagacaggtagttcaaagcccgatcatgttggaaaatgggatcagactgtcgggaaaaccaattttgggaggctatgtcttgtggaaggaaaacctgtcggaattacaggaaatcgtaagagagcttgaagacaggaaggaagaattaaaggatgcgaatctgattgaggaagaaaatctgagaacaaaaagagaagtagaaaaactttctgtgaagaatcagctttatgataaaatacagaaacagacagcaaggcagagtgcacttttgatggaattcattgaagcatattctatggaagaagatgagaacaaaagggaaaaaatattagggaagatagttgtgatcggagcctatataaaaaggcgtagtaatcttatttttattgcggagcagaccgtaaaatttccgatcagagagttggagttatgtttcagggaaacgataaagaatctggaatggaaccatgttgaggcaggtttttccaccgctttagatgaaatacgaagtgaagatgctatgcagatttatgatttttttgaagcagtcattgaggaatctttggaagatctgtcggcatttactgtaaatctgaaacgcagagaggcgcggatcatcatgtctatgagtgtggaatgcaaaacagatctgcaggaaattgcaagacgatatggagcttatgcggagcaggattttgacggatcatggctgctttctctgattctgggaggaggtggcggcaaatgataaaagcatttgaaaactgttcgccggagtatcagattacgatcatttgcttttttatttttttgactttgctgtatatgattctggttatttatgaaggaacaggaaaaagacaaagaaaaatgttgctgctggacagtgtattgcttatagttattttccttataacatccggcttgtgtgcgcggcaacggatgtttaaaataccatatgtgattttaattgttatgggaatttgtggttttttatatgtaggaatgaagatctttggaattcataagtaccgcaagaactgcctgagggaaaatgcagttcaggagagtctggacaatttgccgagcggaattgttttttttgatgggaacggaatgcctaaactgatgaatcggaaaatgtatcaaatttgtcaggatctggcgggaagagatatacagaatattacagaactgaaggaagcactggaacatcctctgaaagagaatgtattttatgatgttgatctgaaagtatactgctttgcggatggaagtgtgtggaaattttcagagaaagagattactacgacagccggagatcgattctttcaatttcttgcttctgaagtgtcggaattatatcggaacaaagtattgctgaaggaagaaaatcagaaacttcaggaaatgtctgtggctatgaaagaactttctaagaatgtaataactctgaccagagaagaagaaatgttatctatgaaaatgagagtgcatgataatctgggatatagtgtcctggcggcacagcggatgttgatgcgggaatcagaagcagaccgggatattttccgttcgcaatggaagcagacattagatttgctgaataaagataacaagtctgtggaaggcgaacaactgcacaggcaggtgcaggaaagagcgaagactttgggtgtgaaaatcatttatacaggaggaaaagtctgggaatctcatatttccaaactgatggatacaatacttttggaggcgctttccaattgtgtccgccatgccggggcaagcgaactgtatgtaaaatccggcagtgaggaacaagagtggattatagtaatcacagataatggacaaaaaacggagaagaatgtcaaagaaggaggaggattatccggtatacgaaaaagggtggagcaatgtggaggtacattgagaatctgtgcggagtcaaaattttcgataaccgttaagataccaaaggaggtgcggagatgatacgggtactaatcgtggaagaccagcgtatggcacgggaagatatggaaaattatatccagtccagtgggagatattgtctggcggcatctatcacaaacgcagctatggcagaaaccgtatgcaggcagagcaaatgtgaacttgtcttgatggatgtctgtacggagaatgatgagagtggtcttgtggcagcagagaagattaaaaggaccatgcctcagataaaaataattatcgtgacttctttagtagagtgcagttttattgacagggcgcgcaaagcgggagtagaaagcttctggtataaagatgccggtaaagaggaactgttggaggttatggatcgcacgatgaaaggggagagcgtgtatccggatgctccgccggttgtgatgatcggaacagcgaaaagctgtgattttacaccgggggaattagcagttctgcgattagtggtggaaggagaatcctataaaaaaattgcagaaagtttgtgtatatcaccggagactgtaaaatggcatatcaagaatatgctgcagaaaacgaattttgattccaaaacgaaattggcggtagctgttacaaagaaaaatctgattataaacggattttaaaaacagcattttactacccacatggggagtgtttaaatcgctgaaaaccgttatcatatactgtgtaaaagtgtcttaatcttaagatcttatttttggttgagatgtcagatgctttataagatactgtctggaagggagaaaaataatatgagatatattatgagaaaaatctgcctgttcccggtaatgattgcggtcatagtttttacagggtgtgggcagaagaaaaacgaagatccggtaaccgttacattatggcatgtatatggcggacagacagaatcgccattaaacgatctgattgatgaatttaatgaaacgattggaaaagagaaaaatatccgggtacaggttggcagtgttacaaatacgaatacgatacatgaaaatgtgctggcatccgcatttggagatccgggggcttccaaactgccggatatgtttgtttcctatcccaaaacagttctggcgatgccggatgatacggagcttgtagattattatgattattttacagaagaagaactgaacgaatttattccggcctttttggaagagggtgtcattcatgaaagactttccattttgccggtagcaaaatcaatggaagttatgtttatcaataaaacagcatttgatcgttttgcaaaagaaacaggagcgaagatagaagatttaaaaacatgggaaggactcttcgcaatggcagaacaatatgctgcatggacagacaaccagacgccggacgttcctggtgatggaaagaattttttcgttcatgattatcattttaactattttcaggtaggtgtagaatccctgggtgaaaatttctttaaaggagaaaatctggctttcggaccggaatttcaaacagtgtgggaaccttatgcaaaagcggcactgtccggaggagtatggcttcgcggcggttatgcgacggaacctttgcgaacgggagattcgattgtatcggtggcctcgtcagccagcgtgttgtattattcagacgaagttacgtatgcggataatacatcggaaaaagtagagattgtttccatgccatgtcccgtatttgccaggggagaaacgatggtcatgcaacggggtgccggtatttgtacggtaaaatctacaccggaaaaagaaaaagcctgtattacgtttcttaaatggctgacagaggcccaaaagaatgtggaatttgtgaccagtcttggatatatgccggtaaagcaggaagctttcgatgtttaccttccggaggcgatcgagaagttaagtgatccgatgtatgtatccctgtatcaggcttttttaaagacgcaggagaactatacattttatactgctccgaaattggattcctatctggatctggaaacaaagtttgaagaacttatcaggcaaaccctgtcagtaaagcggttggagtggcaggaacatccggaagatatggataaacttgtttcagagacattagaggatttcaaagcagcatacacacaataatgtctgccggatcggcaaaagaggtggctgacatatgggagaaaagagaataaatttccggaagattataaaaggaataaagagacaaggcatccgtatgcagcaaagactggttgtttattggtgcgtggtgattttaacactttttttagcgacagttctgttactgagtattattggagttcttccgggaatggattttaaagtacgggaaatgttgtctgcccagcagaagaatacgttgtcagcgatgacagagcagaccgacattatgatggcgagaagtatttctttatcggaagatattacaaaagaattgaatcaatgcctgacagccaatggaaagacattttcagatttgaatgataatcctcagttgatcatggatttagagtctgcgctgtatccctccttgaaatctgcattggatgtgaagtattgcagtggagtttttgttgtattggatgcaacggtaaatacgaagacggaatatgcagatacatcacgcatgggaatctacctgcgcctgtctgatttaaaggcagtaaatacaagcaaacagcacgtagtttttttcaggggaaatgctgatattgcaagagcagagcaggtacagctccataaccgttggaatttagaatttgatacgtccgcattgccgggttatgaacagattatgcagtttgatgggaaccggctggtagagagctgcctgtggacagaccggctggagctgagtgacacatgggaggatgtgcagcttttatatgtcccggttttagatagtaccggaaaagtacgcggtttgtgcggtatggagatgagtaatctgtatttcaggctgtcttatcctatggtggaaggttcctgtgggaatatagtgacagtactggctcctatggacaaaaaaggaaacatctatctggataaggcgatgttcggagatacaaaggaaacgtatctttcaccatcaggaacgatgacagtgaagaaaggaaagtattataatacatattctaccgctttcgggaattatataggcaggcatgaactgcttgaattgaagagttgtaatgggatgccgcttgcggtactgacattgatatcagaagcgaattatgaaaaattaacagcggacaatcgaagggactggatcatcggtacgttgttattcctgattttattattgattgtttctgtcagtatgtcccgtcgttttgtgaagccgattcttcggagtttaaaagcactgcaggaggatacgctgacagatgaaaatttatcaggaatttcagaagtggatgcactggttgattttatgcagaaaaaaagaaatacggagaaactggaaaatggaggcattcctccgaatatagaagaaatgctcaaggcgtttgctttgcgcgtggaaactctgactccgtcagagaggatggttcttcagtattatgttgatggatatacgatacaggagattgcttcactgctttatatcagtattggaacagcaagaaagcataatacaaatatgaatcgaaaactgggaataactgtcagagaggaattaatgctgtatattgagttgtttcgaaaatgcgatcagttagataagctgacatataatagaactgagtaaaagaaaaagagtctgtacaggctcttttttagtttgaccgacagatatcgtttacatttttacaaaaagaaattacgtatatatagtagacggataaaaaagaaacgctatatatagtatactaatcgttcgtattttggaaaataagcaaaatatacgaatggtgaccatagtatttgctttccgtatctgttacgctttcattacgaaatggtggccgcccgataaaaaaaataaaggaaatggataaggagggagaactaaagaatgggatggtgatagagcaaggaggttaacaaggaggttgaaatgtggaatatattacgaaaaaggatttaatagattgttctacaccggatgagttttgcttttcactatgctgcatggaatgtaaaacagtatggaaaagcacaccaattcgtttttccaaagcggggaaaaaaccggaaaatgaaaatcggaagattatttatgatacgctttatgaccgggaaaagaatttagcatttcaaaaagcagtgaatcaggcgaaagaaatctttaatatttgtccgatatgtaagcgtcttgtatgtgaccattgctttttgatctgtgatgatttggatatgtgtgtgcaatgtgccgcaaaacttaatgaaaaaggtactgttgtaggatgaaaacgaaaaaagaaaaacgaaaaagaaaggagaactttactatgaaaaaatatgagattttaggaggaaatttaccagttgtcgtatgtgaattagcagcaggagaatctatgatcacagaaagtggaagtatgagctggatgagcccgaacatgaaaatggagacggtttccggtggcggaatgaagaaaatgttcggcagaatgatgtctggtgattctgcgtttcaaaacagatataccgcagaaggtacagacggaatgattgcatttgcatcaagttttccgggagcaatcaaagcgctggagattagcagcggtcactccatgatcgtacagaaaagtgcattccttgcttcagaagaaggcatggaactgtccatgcatttccagaaaaaattaggaaaaggcatatttggcggagaaggtttcattatgcagagattgagcggaaatggaactgcatttgtagaaattgacggacatgcagaggaatatgatctgagtgccggacaggaaatggtgatcagtaccgggtacttagcggcaatggaagaaacctgtacgatggatattgtaaccgtaaaaggagtaaaaaatatgctgatcggaggagagggcatttttaatactgttgttaaaggaccgggaaaggtgatcttacagacaatgccaatcagcaaggtggcagaattgctgactccgttttttgcagataagaagtagtcgaaagggaagaggcttatgagaaaaaaattgaatttgttattaggattagtgtttatcatcagtatggcagcactgaccgggtgtggaggttccggaaaagcaggagagaagaatccatatgaaggaaaatgggtagcggtctccgctcaaatgatgggaatatccgtcagtgtagatgaaactttcggtggtgattttgaatttgaagtgaaaaatggcggaaaagtatccttttcagtcggagacactaccggaaatggaaaatggtctgtcgaagatgatcagtttaccttgagcatcgaaggagaaaaaatggtgggaaccatcggaaaagatatcatttcttttgacgacatgctggagatgggagtaaaggtgatttttgcaaaggatggaaccgatgcaatggatccttcgctctatctgacagaggaggaaagtgcagtcataggtaagtgggcttctgaaagcgtagaagaacttttaggagacggaccgcagacttctatggaaggcgtagacaacatcaatgatgcactgcgtcttgatttcaaaaatgaccgtaatgtaacagttatttataaaggaaaagagatagggacattcccatggtcagttgcactggggtattgtgcgattgaatcagataacccatctctctcagtggcgataaatgacgatggcacgttgaaagtagattacagtaatgacgaagactactacacatttcattgtgtgaaaagtgacggtaaatagctgaaacggatatggaaagcgtgaagggagggaagataccatgaaaaagaaattgtggtgtgtgttgtgtatcatgacatgcatgatgatgatagcggcatgtggacaaaaaaaggctccggagaagaaaaaaacagagcaggcagaaacaaaatttaaggacagggaaaatcttaaattaaatttatttacagtgtattatccgaaagcatggaactatgataaagaaaatatgaagaaagataaagactacgctcgcgttagattttttgatggagatacagtagatgaatccgagaatgtcatttatatagaagcaacaaaggaggattcctataaatatcgaaatagtttagttgacttcggcgtggatttagagacatatgcaaaaggaaaaatggacactgtaacaataggaaatgcagaatatacagcaatgccggaaggtaattccgtagagaaaacgtatatgtatcgccatgaaaagtctggtacatcctatgatatcagagtaaagggacaggaaatagatgattctgacaaagaactgctggaaggaattgtgctgaaattaaaggatgaaggaaataaagacgcaccatggccatgggagggagagcctcttgaacctgtattggcaaagcagatggtaggttcttatacaatcgttccggaatatattccgtttaaagaagcacagggtgtcatgcagatcatggaacatcagtttgtaaaacagggcaatcatgtattccatttgctggagaacaaactggatacttatgaatattcagaaagcggactcaaattcgtttcttcgatggaactagacgatgattgtgaatatttgtccggagacaacagtggaatgttatatctttcgccgggaatcggagatgtaattggcgtaaaagatggaaaaaaggcaatgcagacaaccgtagatggacatttgaatatgcatccatccggagaatggggaatcagtttctgggtgaacagtgatactcagaagattgcaaatcaagatggtaacctgacggctgagccgtggatactgaccggattaaacaatgatgaagaacgcaagggaccattttccatgttagatgacgtacagatcacgaatagtcatatcatggttgccggctccatggctgcggaagatgaaggtacaaaaattattgtctatgattatgaaggcaatcagcttttgaaactaggcggagaagacatcagttctaaggacaagctcggttccattacgggcatggcagaaacagaaaatggttttgtggctgcagatggaaatatgcgtgaaatacaattttgggcaaaagatggaacacacataggtgcaatttctacagatgacatattcggtgtcagttatccatggctggaagacatgcagcttttagatgacggctctctgttaattatgctgacacaggaacgagacgacggatcagcaaatgaattaatgtttttcagattgacaggtttttaattgaaaaaataaaaatcgcttgccggcagaaatttatctgccggcaagtaattttttgtcagaaaagcctatttttttgttgactgcattttcagacatatgggacttgtggaggaatttggaaaatttgcattttgcatttaaaagatataaaatgaatgtctacggaaagaaaataagcgaatttatgaaggagttagcgaatgtcaaaagacgaatatttaattacagatgcgcctcttaaagcgctgactgtttttgcaatgcctatgattttaggcagcttttttcaacaagtatataatatggctgattctattatcgttggtcagtttgttggctcatctgcacttgcggcagtcggtgcctgtgctgcacttacgaatgtcttcatttgtatagcattgggtgccggtgtaggtgcaggtgtacttgtgagccgttattttggagccagagattatagtaaaatgaaaacaattgtgtcaacatcattgatcagtttcctgattctaagcatacttctgggtgtctttggatttggtttttcccattcgatgatgagtttattacagacacctgcggatatactggaggaagcagtactgtatctccgtgtttattttgtaggatttccatttctgtttatgtataacatcctttcaacaatgttcacttcgatcggtgaatcaaagattccattgggacttttgatattttcttctgttttgaacattttaatggatctctggatggtggcgggacttggtttgggagtgtttggtgcagcacttgcaacgctcatcgcacaggggatttcggcagtgttttcacttttgatcttctttagcaggatgcgccggtatcaaagtcattttgactggtttgataggcatgaattgtattccatgctgcggattgctgtaccttcggttctgcagcagtctacagtgtcaatcggtatgatgatcgtacaggcagttgtaaatccattcggtacacaggcacttgcaggttatgcggcaacgatgagagtagagaatgttttttcattgatatttgtatctatcggaaatgcagtctcaccgtatgtttcccagaatcttggcgcaaagaaaatggatcgtatcaaaaagggatatcacgcggcactggtgttagatctgtgttttgcagtccttgcttttgtagtcattgaaacactgcatacgcagatttcttcgttattcctgggcaaagatggatccgccttagcatatcaggtgtcaggggattacatgagatggctcggttactttttcattttcatgggtatcaagatggcaaccgatggagtacttcgcggacttggaatcatgcgcccgtttctcatcgccaatatggtaaaccttgcgattcgtttggcagttgctttgatttttgcaccccggtttggcattgcatttgtctggcttgctgtaccggctggctggtttgcaaattttttgatttcctatgtggcacttaagaagagttattgacatatgctattttcccaatattttagaattccttccggcggatgataatgaaaagatgccgcccattgttctgacggtagatgaatacgagacaatccgtcttttggacaaggaaggttatagtcaggaacagtgtgcggtatttatgcagattgcaagaattacggtccagcgtatttacgagaacgccaggaagaagatttacggaggtgtttcaggggatgcggatgaggcagtaaaagcacttgtcaatgaaacacttgattacaatccggatgtaaagtgttctcaccatgagcacagccatgaggaagggcatacatgtggcgagcatggatgcggaagccacagctgccattaagaagaatacaaaaaggataatataaaacttggccagacacaatatatagttgtcgaaaccgaattcgagtaaaaaaatgaatccttgaaataagagcaaagacagcttgtatttcaaggttttttaaactaccgataaattgacgaataatcgaatatgaaatataataattctattcaatacatttcgaaaaaaattaaagaaagatctaaagccaatatatagggaaaattctgtgaaagagctttggggtattatgaaaagatgtaaaatcctgagaacagaggggatggatgatgaaaaaaaggataacatttatgctgattctcatgctggctgtaacattgatatctggatgcgggaaaacatttctgagcagattattcagatcagatcacggagagtttacagaaatccttacagattttctggatgcggcaaatcagaatgataagaagaaaatagaaaaattatttgcaaaaaatgtatcaggagaaaagtttgaaaagcaactggacaaatttcttgaattttacagcgagacaataaaagacggaactcttgataaggatagtattttaatgagagtaacaggaagtcaggacagaaatctttatcgtataatggattcaggtgtaaaaataacaaaaggaaatcagacttattatatttatatggaggttgtcacggcggataaggaacatccggaaaataaaggaatccagattattgatctggctacaaagaaggcgtataatgacagatattttctttggcattcaaaacaaggaatctatacacaggagaaatcctgtgaagattatcagacgatgcttatatatggaaatctaagagaatattatccggttgacagagagctttcggctcagtattttacagattttataaagcgaagtacagattataaagaacttcaagctgagattggaaagccaaatggagaacttacagaagatgagatatttgtttttgaaattacgcagggagtggatgagaagacgtatgtgacctgtgagacttgtggagatgagattatcagaataaaactggtaaatgaagaagaggtgcttgagacaatttatgaaaaagatttggaaaatgattaaaacgagaaggagggattctcatgaaagtaacaggatgtaaaaagatctataatgcagaaaacatcatggaagcagagatgctggtagaaatgttaaaagaaaatggaattgctgcattcacacaggaaccaagttcaagtgtagcggcatatggagttgccggatttggagtatacggcgttgatatctgggcagaggcggatgaagcaaaaaaagcagtgcagattatagaggagattgaaaaatctctggatacagagaatgcggaataaaagaatacagagaattattgattatctgagacatggtggacgaatcgggaaactggccgggatagctgccggcgcactggggataaaaccgatgattacattaaaagaaggggaaatcttcagttccggactggcaagaaaccgtatcaaatctatgaaaaaggttgtagatatgacgaaaaattatctggacgagattgatgcaaaacctggtgaatatgatttttgtatcgactatgattatgactatgatgaggcagtcagattccgtgagatgataaaggacctgataaaagaacggcttggaatcgatgagattggaatctaccagatcggagcaacgattggtgtgcatacaggaccgtatccgcttggtgtcggaattattaagaaggcagaagtttaagcagttgaaaaagcggaatgggtagatggtggagagaggccgatgcccataatcagcgaaaatagaatatggatagataaagatacctgagaagagaactctttttgggtattttttaacatagttggtaattttataccccacctgatgttataaactatagacataaaagggaaaacagatcatttattttcaaagaaatggaggaactggcaatgaaaggttttaacacaggtgacggttatatgggaatggtagatggcgaatatatcctatttgccagcgaagcggattattatgattatgtgaatgattaaaaaacaggaaatatgtggaatatatttcccacgcatgtgctatactgaacttaattaaccagaaggagaagttctatgcaggtatcagacaaattaatcaagccgctgacagaagcaaaatatttaaatgccgataacgtaagcagataccgctgtatcatgcgtatctttttcgagcattatgagaaattaaaatactggctgtatcaggaagaggtctatgaagaaatgatacaggacccgctttttgcggattacagaccggaacagtgccagcaggatctcaccatgctgacagagtggaagaacctgaatacaatccaggatacaaaaaaggtcgcatccatcgaagaattcaagaacaaaaagtaccggtatcagatgacagagtacagtgtggagatagagcgtctggtaatccggttagagaatctgttcatcgagggagcatcattagaaccgacacttctggagcgcataaggagaagtgtagagcattttccagacatggcaggaaaagataagaatgaagtatacacatggtggacagatctgaataatgatttcgtccggttgaatcagaattatcaggattatatcagggatctgaacagcgtccgggcagaagagatgatgcatacgaaagaattcctggtgttcaaggaccggctgattgaatatctgcgcagcttcattaaaggactgcagagaaatgtcggagtgatcgaagaaaatctgcgtttacagaacgaagaactgaaaaagcaggtatttgaaaaagttatagattatgaattgtcaattccgcgtatggagatagaagtctcgaaagaaatgatagagcagaaagtccagggacgatatcagagcatctatgactggttcgtgggaaatgaaggacaggagaatgaagcgggaaaactttttgatgccaccaatgatatcatccgaaggattacaagatacgctgcacagttgagcgaaaagaatgcactgggtgcgaatagaaaagaggaataccggaaagtagcagaattgttcctgcggtgtcaggatgtggaagaggcgcataagatgtcggcgatggtattcggcatggaatgtccgcagcatcttgcaggagatctgatccgtgagacagacagcatgaacatcggagtctacgaagagcggccaatggaaattactctgaaaccgagagtgcgtacataccgagaaaaatccaggagaagcgccatccgtgaatcagcagagcaaaagcaggaaacaagacgtaagttgcttgagaaacagaaaaaagagacggaaaaactacaggcgttggaagtagatggaaagatatgttttgataaactgcctgtattggaacctagaattcgcgagattcttttgaaatggttgtcagatgccatggaatccgcagatttttcggcaaggacagacgatggaagaagatatatattggacagaagtcaggcaggagaaaactgtgtagtacattgtgaggatggaaactttacaatgccgaagctgtccattgtatttcaggaggaagaatgatgaaggagctggaggttcttttaaataaaagatgggtattaaaatccagagacaaagaaatgtattataaaataagagatgcacttggagaacttcggaaatttactacagagaagatgggatgtcagatcattgataattctctcctgatcaagatggagaagattccggtaattccggaaagcttcatgggcattcagaaattttcgtcaaaagaagagtatgcttatctatgtatcctgttgatgtttctggaagacagggatgcacaggagcagtttattctgtcacagctgacggaatatatcacggcaaatctgccgggagatatctcggactggactttgtatacgaaccgaagaaaactgatccgtgtgctgcgatttgcggtagatcagggaatggttgatgtcacagacggaaaagacgaagcattcatggatgatgaggccggagaagtactctatgaaaatacaggtgcgtccagatactttatgaagaatttttcgaaggatattatggagtatacgaaaccggaagattttcaggaaagtgactggttcgaagtggacgaagaccgtggatttgcaagaagacacagagtctacaaaagactgatctttgcgccgggcatgtataaagaagatggatcaccggaagattttgaatatttgaaatattatggacggagattgagcgaagaactggaacagatcttcgactgtcaggtgcatattcacagaggaagtgcgtatctgttatccggggatgagtgtagaatgggaacggtatttccgggtaataattcgatatccgatattttacttctgtgttttggcgaaatacgaaagaagattgagaatggcgaatggaagacggcagcggatgaaagttgtcttacagatcggatcgagtttgaaaatctgataaaagaagtgaaacaggaatatggaagtggattttcaaaaaattatcgtgagatgccggaaggtgaatttgtaaaaaatgtgatcgatgcaatggaattgtggatgtttataaggaaggagaaggcagctcatcagattaagatctgcccgctcacaggaaagatacagggaagctatccggaggattatacgggaggaagaaatgatgaatagtagatggcaggcaaataagatcggactgattaatttctggtattatgatgaacaggaattcccgtttgtaaaaggaaggatgcttcttcgtggatcgaatggatcgggaaaatccgtaaccatgcagagcgtggtaccgcttcttctggatggcaatatgagcccggaacgattggatccattcggttccagagaccgtaagatgagcagttatcttctggaggaagatgatggacgcgaggagcggaccggttatctgtatctggaattcaaaaggcaggacagtgacacatatctgacgatcggtatgggaatccgggcgagaaaagggaaaaatctggacaagtggtattttagtctgacggatggaagacgggtaggaaaagatttcttcttatataaagacacaggagaaaaagtcacactttccaaaaaagaactggagaacaggattgggacaggcggccgtgttattgacagacaggccgattacatggagtatgtcaaccgccagatcttcggattcgagacggcagaagaatataaggaaatgatagaccttttaatccagctcaggacaccgaagctttccaaggattttaaaccatctgtgatcaacgatatcctaagcgattcacttcaaccattatcggatgatgatctgcgtccgatgtctgaagcaattgaaaatatggataccatgaacatgaatctgaagaatagaaaagaagcaaaacaggcagcagagaagattcagggagtattttcaaaatataatcagaaattattatacgaaaaatcagaccggtatgaacaggcagaaatcaaattagaaaatgccaggacacagcagaaagagcaggaaaagaaattatccgagtgcagacagaatatcgagaagctgcaggtagaacatcaggaactggatgcaaaacatgagtccatggaaaaagaacgggaatctctgaataaaagtgatgctgtagcattaaaacgaagagaagcagaactgaccacagaattagaggggcagcagaaaaatctaagagaaaagcaacattttcttgaactgaaacaagagcaatatcaggatgtacagaatcagatcaaagcagaagaagaccggaagtatgagaaagaaaaagaactggaagaactcatagaagagatgcaggacgaggcagatatcatggctttcgaagaacatgcatttatgaaagaagaactggaaaagcatccggaagaaccatataagttcgaattacatcagcagcaatatgagcatacgaaagaaaaaatcaatgaaggaacagaaatccttgcagagacagatcatctggaaaggcagaaagacgatctgatcaaagaaagagaaaaacggatccgtgaattggatacactgcagagaaaagtatcggaactggaatctgtattcgtgcagacacagaatgaatggaaagaagccctgtatcagtggaatggtgcgaatcgggaactggtactggaaaaagaattactaaaagagttaagcacatttgcagaggcttatgaagagacatctgatttcgcagaggttcgtcagaagattgcagatgtgtggatcgggaaaaatgcggatgttgaatctgggatttctgcgaacagggcagagaaagaaacagcagaaaaagaactggaagaagtgaaagcagaactgacggaatgggagaatcagaaagaaccacagccggagcgctcggaagcagtcatccgtaaccgtcagagattggatgcacttggaattccgtaccaggagttttataaagttatagagttcggagacaatctggatgaagaagattgcaaccggctggaagaagcattattgaaaatgggaattctggatgcgctggtgattgatgaacaatacaaagagcaggttctgcatttgaaacagggatgtgaagatcgttatctgtttagctgcaaaaatgttcagaaagagctgcaaccaggaaagagtctgttagacgtactggaactgaacgaagaagtcaatgacattttctccaatcagcgattgacgggaattcttggaagtattgcatatgataacgaaagtataattacgattgcagaagacggtacctatcggatgggagtacttgcaggaacggtaaccggagaatatgaggccggattccttggaacaaaggcccgtgaaagacacagacaggcaaagatggaagcctgcagacagagaatcgcagggctggaagaagtattacggcaactggaagaaatgtatcggaagttatccgaaaggaaagtcattctcagacaggaatatgagaatcttccaaaagatacggatatgcgggaagcccttcagatgatgcgtgcggaggaacgggcatgtgaacagatcagacgggaaagtgataaattagaagagaggattcgtgaactgatcgaaatattaaaagagaagaaaaagaaaacactggaaattgcggattctctgtatctgacctgttcttatgaagtattcaaagaagcaaaaagtgcagcggaagaatatggaaagcatctgattagtctgattgcagcacatgaaatgttcctcagaagcctggagtatctgaaagagaggagagaacatctggaagatctggatgcagatatggaacagatccggtatgatctgttcgagattcagaaagaactccggagaaagacggaagaacagacctctattcaggaacaattacgtctgaccgattatgaagaaatcaaagaccgtctggatgcatgcatcaagtggcttcaggaatatccggaaagactgcgcatatgtgtaagcagacagacgcatgaagaagacgaagtcggacagctgaccctgcgtctggaagagggtcggaagagaattgaagaatatgaaaagaagacggcatatttttcagaatgttatgagcaggagaagagtctgcactatgtggaaataccggaagagataccggatgatgccggacatgtacggagctatctggagtctgacgtgaaagcactggataaagacagtgtgatccgtgatctgaataaagtatattttgaaaatagaggatttctgaccgattatcatctgatgcagaatgaattatttgcagaagcagagcagacagaattcccggcaaaacgactggatatttcggccagataccaaggggtaaagatatcattttcaagtctccttacacatctggaagaagacattgaagaactggagaatctgatcaaagacggtgacagggaactgttcgaagacattcttgccaatacggtaagccggaagatccgtggaaagatcaatgcatccaacacatgggtacagaagatgaattccctgatgaatgggatgaacacatccagcggtctgaaactcagcctcagatggagaagtaagacggcagaacaggaagaccagctggatacaaaagaactggtggacctgttaaagaaagattaccgtctgatgagcgaagaagaagcctcccggctgtcggcacatttccgttcaaaagtagcagaagcgagaaggaatgcaagagacagtgccggaatgatatccttctatcagattatgaaagatacactggattaccgtaaatggtttgaattccagctgttctcacagaagaacggagaacgtcagaaagaactgacaaacagtgtattcggaaccttcagtggtggagaaaaagcgatgtccatgtatataccgttattctctgcggttgtagcgaagtatcagggaggcagagaagatgcaccaagactgatctcgctggatgaagcatttgccggagtggacaataagaatatccgcgatatgttccgcctgatgacagagttcggatttgactttatcattaactcgcaggttctgtggggcgactgtgatacactggatgcactggcgatctatcagctgatccgcccgggcaatgcaaaattcttgacggttatgccgtatctgtggaatggaaagaagaaagaattgttggaacgtgaagaggaagtagagcagagaggggccgagattggacagcaatgaatgagagtgagcaacaagaacttgagaagataaaaaaagaatgcctgacatatttccaccaaagtccagtttgggaaaaagttctgaaagggtttcgtgataaatacagttcttatggaagatttggtggtaaagtagttctgaagaatctgaaatcacaggatatcgaagaactggagggattcttcggcaagtcttttcacggacagaaaagtgtgacagtgtctgcagaaaaattccggcaggcactgaaagcaagccgctataaagatatcccaccggaatgtctgttggagaattttttcggagaacccttgcttggaaaccaggaacagaaatttttgagagaacgggaaaaagagaaaatctggcagaagtttttgaaagactataaaggaactgagatagagaaggcggcagaattactgaggaatattgtcaaagacagtgacagtcaggaacttgcagaatgggattgtgcgctgcggtttggagcagaaatgtacaatcatttgccatatcgtcaaagtgataagttgtatctggctgtatttgcagccatgctgacgggaaatccgcatgcatttgacaatggaactgcagcaggaaatttcctgtatcagatgatacagatggatctggaaatcagagaaattaagatagagtcctcggagatatttccggcgtataagcgtcagaaaagttacctgacggccggaattatgctggatgatatatcaaattatgcaatgttatatcaggtacaggcggtcaagaaagacggaaatcttcataaaggcatggagggatttgcgagtgagcagcatattgtacaggtcccgcttgcggtgattacggagtgggagtcgcttcattgtccacaagatgagatctatattgtggaaaatccgtctgtttttgcggtattgtgtggaaaagagaaatcaggaaacgtaagaatagcatatatgtgcatgaatggacagccaagactggcaggtctgatggtgttggatctatttgcaaagtcgggaatccgggtatattatgcgggcgaccttgacccggaaggaatactgatcgcacagaaattatcacagtattataagggagaatttcattactggcatatggaaacggcggattatgagaagtgcaggtcagagaaagtgatatcgccgaagcgtatgaagatactggagcggattacggataggagattgaaaccggtggtggataggatcgaagagtatgggactgccgggtatcaggagatgttggtggaggagatgtgattatgccaaaaggaacaaaccaaaagctaaaattataccgtcttgcacagatcatgctggaaaatacagatgacgaacactatattaccatgccggaaatcatggaagaactgggaaaatacgaagtgaccgcagaccgcaaaacaatctatgcagatctgcgtgatctgtctgtgctcgggatcgaggtagagggcgaacccatcggcaaccgctatcattaccgcgtagtcaaccgcccattcgaactgccggaattaaagcttctggtagattccatccagtcttccaaattcatcacagagaagaagaccaacacactgataaaaaagctggaaaagctggtcagcaaatacgatgcacagaggctgcagcgacaggtgtatgtatccggaagaattaagacgatgaatgaaagcatctattatactgtcgatgcaatccacaatgcgatttctgaaaataagaagatcaagttccagtatttccagtggaatgtgaagaaagagatggagctgcgtcacggaggagcgtggtatcatatcagcccatggggattgtcctgggatgatgagaattattatatgatcggatatgatacagaggcgcagctgatcaagcattaccgggtggacaagatgctgcatatccggatgtcggatgaatcccgtgagggaaaagaacactttaagaagctggatatggcggattatgccaagaagagtttcggaatgttcaggggaaaggaaacgtctgtaaagatgctggtaaataacagccttgcgggcgtgatcattgaccggttcgggaaagatgtgatgatgattccggaagatgcggatcatttccgggtgaatgtggatgtgcatgtgagcaaacagttcctgggatgggtattctcgctgggggaagcagttaagatcattggaccggatgaggttgtggagcagatgcggggagaggcccggaggcttatggagcagtatggggagtaggaaatggattctgaattagcaaaacaagaacatgattgtaaactattgcgaaaaataagttgacaataaaagcgaaatacgataaattgttaaccataaactgaaaggaaggttaacaatttaatgaacacaaaaacaaaaaaattatccaccgtaagtatggtattatgcggaatgttcgcagcgctggttgccataggagcatttatccagatcccggttccatatatggattatttcacacttcagttctttttcgtactgcttgcaggattgattctgggggctgataagggagcaatatctgtaggatgttatgtattactgggacttgtcggagtaccaatctttgcagcaggcggaggaatcggatacatattccggccaagctttggttatctggtcggattcattgtaagcgcatatgtaaccggaaaagtatgcgaaaagctgaaagcaagttacaagaactatctgcttgcctgtcttgcaggatttgttgtgacatatgcaatcggaatcgtgtataaattcataatcttgaacttttatgcacatacaccggcaacgctgggcgtaatctttttgtcctgcttcccattagatatgcctggagattttgtattatgtctgctggcagccggtgtgggacttagaatgcggaaaagcggattttatctgagttaataaaaaaaggggcatgagattatggcaaaaggaatatttgtgacgggcacaggcacagatgtaggaaagacatatgtcacagcattaatcgtgaaaaagctggcggatgcaggaatccatgcaggctattataaggctgcattatcaggtgcagagtccatagaagaaagtgacgcaggctatgtaaagaagattgccggtatcacacaggaagacagcagcttactgtcatatctgtatcaaaacgcagtgtctccgcatctggctgccagaatagaagggaatccggttgatccggaaacggtaaaagcagattttgatagggtaaagaaagagttcgattatgtcacggtagaaggaagcggcggcattgtatgtccgatccgctgggatgaagagcaggagatcctgctggaagacattgtgaaaatgctgcatctgaatacgctggtgatcgcagatgccggacttggcacgatcaatgcggttgtcctgacggtagaatacatccgcaatcatggaatggatgtaaaaggaatcattctgaatcattactcgggtggagcgatgcaggaagataatgagaaaatgatcgagagattaacgggggtaccggtgattgccagggtaagagatggtgacagggagcttgaggttgatctggaagtgttgaaaagggtgtatgattgatgatgagaagaggaaattgactgcggttgatttccttttttgatgtatggaaataaaaagaggtgagaatattatgccccaccacctgaattatactatacacatcaaagggaataaaacagaattccgggagataaaagtaattataagacaacaaatcaaattcagatgaacacgtttttttagcgaaaggagcagacacaatggcaaaaatatttatcaccctgacaggaacaaaacactacttcggaaatgattttctggaaaaaggtatgaagatcagattagaaaaagaaccggataatgaatatgacaaggaagcaatcaaagtgacatatgaaggtctcggaaagattggttatgtggcaaatagttcgtatacagtcatcggtgaatctatgagtgcaggccgcctgtatgacaagattggtgacacggcatatgcgaaggtggtattggttacaccggcaggaacaatctgcaagatctgtaaaaagagtttgaaaagtgaacaggaggaaacagcatgaattaccttgtgatagatttagaaatgtgtaacgtaccgagagattatcggagccgatcttataaatatgcaaatgagacgatacagatcggagctgttcttctggatgaggaattcaaaagaatcggaacgcttagccaatatgtacatccggaacacggagtgatcgatccgtttattcagaatctgacagggatacgaaatagtcaggtgaagaaagcaccacgtattgaggaggctctgctacatatgatcgactggatcggcgatcgtgagtataaagtctatgcctggagcggttccgacagagcacagctgcttcatgaaatcaaagcaaagaagatctgtgatgagcggattctggattttgtctgtgaagcaagatggatcgattatcaggatgtatttgtaaaacgattcggaatagaacgaaagattggtctggaagaagcactgggcagggtggagattgaaccggagggacgacttcatgatggtctggatgatgcggtgaatacaggatatctaattgaaaagttgaaaatgaatccagagtataagttagtcagctatgaaatgccagagcaagagcagggacatctgtcgtgtacgcttggagaattatttacgggattggagttgaaattggcgtgagggatgttttgatattcgatgaatataaaaaaagaaacgagcaccccgcttaggcaatagccgtacggtaacaaacccatttcttgtatataatattaatctgtttgttaacaaaagtcaactataaaaatcaaaaagatgaaagttgtgaagcttaactcagtacagtataattaatatatcatttcaattcaaaacataatgcaaggagcacccctatgtccacatcccataaagaaaaaataatccgcgtccttcaacttttccagaccaccgatgagaagacgacgatgaatgcagtgcagataagccagaaactggaagaagaatacggaatggaaaatgtacaccgtacatccatttatgacgatgtgcgtttgttgcaaagctgcggttatccgattaagcaggcagaaaattcacataaaggatggtatatggagaaacatttgctggaagactgggaaattaagctgatgttagattcggtgcaacaggcaaggtgtgtgtccgttcatgaagcgaatgagattcgaaataagctgttaaatctgacgagtcagagaggacgaagcagattttcgcatatgattatgccgctgcccggaaatgtcaggggtgtcggtcagatcggtgaatatatagagattatgctggaagcaatgtatttgcataagaagattcggtttcagtatacagagatcaataatgcaatggagaaagttttgcgaaaagaaggcaagatgtatcagctgaatctgtatacgatatattggtcggataataattattatctgatcggctctcatgataatcatgacgggttgacgaattaccggttggaccggattgaaaatatgagtatgtccagtgaagaaaccattccggcagaagaaaagattggtgtgaatccggaacttgtgattcaggactatattaagaagagtgtgaatcattttagtggggatacgatcagaatcgaagtggaatatgagccgtcaccgagtaccaatgctatattatatgattttgcaggggatggaataagggtcagaccgttagaaaaaggaaagtataaagcggtatttaaaaagatggacagcgtgacattggttggctggtttgtacaatatgcgaatagatttaaagtcatatcaccggagagtctgaaaggtaaaattatagaaaatttagaacaggcacaaagcatatatagtgagtaagaaaagtcctacatgtaatatgtaggatttttttaagcaagatacataagtgttgcgatattgcgacagtagatttgctaaaatgataataactatgaatgatacgatgagaaatagattttacaaatgtaaggaggaagcgatttgaataaaattaaaaggggatagttagaggaaagtaacaaaaagaagatcgggagagtgtatagaacaatattctaaaggaaaagagcttttttgtatgatgcatttataattaggtaaaaacaaatattttatcaaaaaggttgggaaagataaaaatgttgaaaaattactgacttaaaaaagtaaagtactttaaatgtattaatataaaggcgtcaatatattgacgcctaaagaaaggaatgatataataattaagttataatttgacaaaatggagataagcatatgaattgtgataaatttagaaaatggttgcaggaaaagaatacatatacagatgcttctataaaagatattatatcgagattgcgaagagccaataatattctgatatttcagaatgaagatatatatctttttagattagagcagtgtgaagaattccaaaaggcttctgtatcggttaaatctcagatgaggagagctattagattatactttcaatatttaggagaaatggagaatactcaaagatgaagatattatcgttatttgcaaatataggagtcgcagaagcatatttaagagagataggtattgaagtgtctgtagcaaatgagctgatagaacgacgtgcaaaattatattcggcaatttacccggaaacaaaaatgattgctggtgatataacaaatgatgctgtgtttacacagataataaatgctgcaaagaaagaaatggtggattgtataatggcaacaccaccgtgccagggaatgagtacagcaggacagcttgaagaagacgatgaacgaaatcgattagtgattccggtgataaaagcagtgcatattttaaaaccaaattatatttttattgaaaatgttccaaattttttaaatacctctattcaagtaaacgataaaaatattttgattccagattatataagtgatgagttgggaaacgaatatgacatacgaaaatatataataaatactaaagattattcagttcctcaagtaagggagagagccatttttttgataacaaaaaaaggattagttaatagttgggtacttcctgatccggataaaaagataataacaatgagagatgctataggtaatattccatctatcgatccatttattaaagatgttagtaaagaagaaagagagaaaatgtttcctgaatatgaagaaaagaaaaaacgagctttgaaaatatcaagatggaacataccacctcatcatgttaaaaggcaagttatttcaatgatgcatactccgactggagaaacagcttttgataataaaaaatattttcctgttaaggaaaatggaacaccggtaaaaggttataagaatacttataagagacagaattgggacactcctgcatatacagttacaatggataatagaaagatatcatctcaaaataatgttcatcccggaagatatttgggagtagatgagaatggagatgcaatctattcagatgcaagaacattaacattatatgagttaatgttggtaatgagtttgccttctaactggccagtaccggagaaaacatcagaagcgtttttaagaagaatcattggggaaggaattccaccattatttgtaaaaaaagtatttgaacaattgatagagaggtaatgataggatgcgattaaatggattatcgctgttttcaaatgtaggtatagcagaagcatatttgaaggatgttggaatagatattgtattggcgaatgagatagatgaaaaaagggcaaaattttatcaagaagtgtattcagatgcacacatgatatgcggagatattacagatcaaacaactcgaggtgaaataataaaagaagcaatacaaaaaaatgttgaatttattattgccacacctccatgccagggaatgagtgaagcgggattgagacttgaatttgatccaaggaatcaacttatattttatgcggtagatgtaataaagaaagtaaagcctaaattcgttttattagaaaatgtgcctaaacaattaacaacaaaaattaaatataatgggaaggtaattttgattccagagtatattaaaagagagctaggaacagattatacttttaataaagaaacattggtgatggcaaaagattatggcattccgcagctaagagagagaaatatttttcttttagtaaaaaaagatctagaatatatttgggaatttcccaaaaagcaaagggaaataacattagaagaagctattggagatcttccatctttagatccattactgcgagaaggtatagatgaaacaattaaaagatttccagattatgaaaaaaagagaaaagctggattgcaggtatcaaaatggcattatcctcctaaacattcttggaaacaagtagaatggatgcctctgcatttgccatgcgtgaactgggattccagagagtgttatttctggtacacaggaatcagattgcgaagcaggcgcagaagtcatttcgcaaggtattcagcggacaagtttcgatgggactggtgacgggaaaatatcaggaatatgacaaggactttatttttgcaacaatccagacattgagcaaagaggagaatttgcaccggtatgagaagactgcatttgatgcaatcgtaatcgacgaagcccaccacagcgccgccaacagctacaaaaaagtcctggactatttcgaaccaaagctatggcttggtatgaccgcaacgccagataaacgagacgacaatctggaaggcaggaacatttacgaaatctttaatcatcagattgcatacgagatccacctgcaggatgcgatggaggaggatctgttgtgtccgttccattattttggaatcacggatctggatattattgcagatgcgggaaaatcatctgaagaaaaggtggagaacttccgctatctgacatccgaagagcgtgtggaaaatgtcatgaaacaggcggaatatttcggatacagtggcgaccgcgtgaaggggttgattttctgtagccggattgatgaggcgaaggaattgtcgaagaaattcaatgctaagggctggcggacgctggtgctgagcggtagtgattcggaagaagcgagagcagcagcgatcgaacggttggcaggagaagaatccgaagatgccttggactatatcatttccgtagacatattttccgagggtgtggacgtgccggagatcaatcaggtcatcatgcttcgtcctacagagtcgccgatcgtgttcatccagcagcttggccgtggacttcgaaaagccgagaacaaagaatatgtcgttgtactggatttcatcggaaattatcggaataactttatgattccgattgcgctgtccggtgaccgcagttataacaaggacaatatccgtcgctatgtcacggaaggcggcagagtgattccaggtgcgagcacgattcacttcgatgagatttcccgaaagcggatcttccaggcaattgataatgcgaacttcagcgatatcaaattaatccgggagaattatacgaatttgaagaataagctggggcatatcccggcgcttgcggattttgataagtatggggaaatggatgtgctgcggatcttcgacaataacagcctgggttcatattacaaattccttgtgaaatacgaaaaggaatataccatccgattgtcagaagacgaagaaaaagtgatcgaattcatttccaaaaagctggcgagtggcaagcggattcatgagctggaattgttgaaacgtacgttgcagtatcgccatggaatcattgggcgtctgcagaagcatttatccgagaagtatcattgtgagatggacgagcactgcatggaaaatgtgatcaatatgatgaccaatgaatttccgacgagcgcagcaaagaagacttacgcacagtgtgtatttctgaagaaggaacaggatgattacggcatttccgatgcttatgggaaaatgttagagaatccggaattctgtgcgattttggaggaactgatagatttcggaatctcgagatataaggttaattacagttaccattatcaggatacgaatctggtattatatcagaaatatacatacgaggatgcctgccgtctgctgaactgggagagaaatgaagtgccgctgaacatcggcggttacaaatatgataagaagactaagacatttccgatattcattaactacgataagcaggacaatatcagcgataccacaaaatacgaagatcattttgtagcagagaaccggctgatcgcgatttccaaaagcggaagaagcatggactcagaagatatgcagaatttcctgaacgcaacagaacgtggcatagatgtgcagttgtttgtgagaaagaataaggatgataagatatccaaggaattctattatctgggctgtgtgatcgcgaccgggaatgcgaagcagtttgtgatgccgaatacggataagacggcggtggagatcgaatgggagctggagactccggtgagagaagatatttatcagtatattgtgaatgaatagggactgttacaggaagatttttgacgggagataaatggtaagatgaagacgataagagttgtggcagcagtgataaaggcagtaaaggaagacggaagaacgatgatattcgcaacgcagcgcggatacggcgagttcaaaggcggatgggaattcccgggcggcaagatcgaagccggggagacaccgcaggaagcgttgaagcgtgagatcatggaagaattggatacggaagttgcggttggcgaatggatcgagacggtggagtatgattatccgggatttcatctttcgatggattgcttctggtgtgagatcgtgaaatgggatctggtgttgaaggagcatgaggctgccagatggctgaccagggaggagcttacggatgtggagtggctgccggcggatgtggcggttgcgaagaagattgaaggagagatggactagaaaatatagagaggaaaacaaagattagcaacacttgataatgaaagtatttatgaacttatgagcataaagcgaggagagaaagtaacgcttagtgtaactttgctttttagtccatatccacaggcatattttccacaattgtgtattacggcaattgtaattcctgggagaacaataggaagtcttggcgacatgggggaaagattctcagataatcagagaatagaaggaacaattccggaaatgttggatgaggcattattatttgtgaaacgcaatatgcggacaaagacaattataagtccgacaaccggacgaagaactgacagaacagactatccaataacagcggttagagaagctattataaatgcattagtacatcgtgattatagtattcatacagaaggaatgccgattcaacttataatgtttgaagacaggattgaaatacataatccaggtggattatatggaagaatcactatcgaccaattaggaaaaattcaaccggatacaagaaatccggtacttgcatcggcacttgaaacattgggaataatagaaaacaggtattcgggaattccaacaatccggatggaaatggagaaatataacttaagacagccagaattcttggatgaaagaggaagttttattgtaaaactatataaagaatcaaagaatgattatgaagatatgtcaaatgatgaagaaacaaataatttaatagtattttgtaaaacaccgcgtacaagaaaggaaatttgtgattatctggggttaaattctgttacttatgctatacagacgtatgtaaatccattagtagaagctggcgtaattaagttgagtattccagataagccaaagagtccaaaacagttatattatagcggagaaagagaaaaatgagagaagaccaattcctgcggcagcgtctgcagaaagaaatcccgattgagatttcacctgttttaagagatttaataactgttatattttgttattaaattctccgcaaacccttgaaaatctttgtgtgaatcctctatttcggacaggagataatttgacaggaaatttcaaagaagagtataatacatattaagacattttgaatcggcatgtgtccggaagaagctgtcactggcaggttctctgtattataagcaggttcgaaatagacgctatgggggaaaataatttggaaaaaaaactgacaataaatgatatagcccagatgtccggtgtggcaaaaagtactgtatcaagatatctgaacgggggaagcgtcaaagatgcaacggcccagaagataaaaaaaatcatcgaagaaaataattatgagccgaatctgtttgcaaggctgaatgcaaaagagagccggatcataggacttacggtacctggatttaactcggtaacaacaccgagacttgtagaagtaatcgttgcctatcttaagaaaaatgattatacacctcttatcatgcatacggaaaatgatatcgaagaagaaatacgctgtatcgaacggctgaagaatatgaatgtagatggaattatggttcttgcgacgggaagcacaaaagaatacgaagaagcagtaaagaagttaaaaattccaatcctgtttcttggacaacgcttcccgggagagaattctgtcattaatgatgattacaatgcaggatatgcggtgggtaattatatcggacaacgtaagttcaaggagatttatatgctctgggtacctgaagatgacccggcagtaggaggagaacgacgccatggagtgatcgatggacttatgtcctgtgagaaaaagccaaaagaagtcatagagacaacgttcttttatgaaaatgcaattgaaaatgtacagaaatttgtagatcatatgaagacaccggcggcagtcgtatgcgcaacagaccgtatcgcatttggcgtgtacaaagtaatgtcagagaaaggtatacggataccggaagaagtatccgtggtaggatttggcgattacgaagcaggagaactgttacagccgccacttacgacggtaaaatttgactggaagaactggggggagatcagtgctgagtcgatgatccagatgattttaggaaagccggtaagcccgcttcaggtcaacccgtatgaaattatagaaagaaaaagtgtaaaagagaactgagaatcaggcggatctgtcaatttgacagacctgcttttgtgcaatataaacaaatttagatatcaatttttggaaccgtttccaaaaatgaaattgcagtgacgttttgtgttgacatacaaaagctgatgtatataataaaaacataggaacggaaccggttccaaaacaaaacaatacaaggagaagagaaatgggaaagaacaatgagtatctggaaatatcaaaacagatcgtagccaatattggtggaatggataatatccagggaacagcacactgtgcaaccagactcaggatcgtattgaaagataatgatcttgcagatattgaaaaactggaagatatcgacaaagtaaaaggtgcgttcatagcaggtaatcagttacagctgatcctgggagctggaacagtgaatgatgtatatgaggtatttgccgagtatacgaatacacagaatatgtcactgggagatctgaaggaagaaagtgcgaagaggcagaatccacttcaggcagtgatcaaagcgttatctgatgtatttatcggaatcatgccggcacttcttgcagcagcccttctgatgggaattacaagcgtccttggcggacttgaagtagtaaagacacatgataccttatatgcgatcaaccggctggtaagtcttgcgtctacaggtatctttgcaatccttccaatggcagtatgctattcagccgtaaaaagatttggcgggaatccggttcttggtatggtaatcggagcaatcatgttagacagttctcttgccaatgcttaccaggctgcacagggaaccgttgatatagaagttatccgtctgttcggactgaagattgagatggtaggattccagggaggaatcatcatcgcgcttatgatgggatttgtagttgcaaaactggataaattcttcaataaggtaattccggatgtaatcaagcttctggttgcaccaatgctgacagtatttatctctacggtattactttttacacttgtaggtccggcaggacgaattctttctaatggaatcacagacggactgatgtggggtacagaacatctgggagcattcgggtatgcgttatttgccggagttcagcagatcgtagttatcacaggtcttcatcacattatcggtgcggtagaagcacagcttattgcatcgacaggaacaaactttttaaatccactgatgtctgtagctttatttggacaaagtggtgcggtacttggttatctttccctgaactggaagaacttaaaagccagagagctttgtattccaagtttctgctcgacattatttggtatcagtgaaccggcaatcttcggagtaaacttacgttacaagtttccactgatcggtggatgtatcggtggtgcagttgcaggtgcatatgtatactattcaaagcttactgctcttggattcggtacaactgcacttcctggaatggcaattgctaatccggcacatcacgggtacattaactacatcattgcacatgcaatcgcgattatgattggatttgtatgtacagtcatctttggaaaaatgtggtcagcaccggataagaataaaaatgacaaaaagaacgatacaaaagaaaatgatacaacaaaggcagttattacagaagagcctggtgcagtctatgcagcagcagagggaacagtaaaagatatcgaagcatcgacagatccgacatttgcaaacaaggtacttggagacggtgtcgttatctttccggaagacggaaccgttatggcaccatgtaaggcaaccgtatcactcgtatatccaaccggacatgcaatcggacttacaactgcagatggagcagagatcctgattcactgcggggtagataccgtcaatatgaacggtgaaggatttgagacacttgtaaaagaaggacaggaagtaacagcagaagaagcacttatcagatttgacatcgacctggtgaagaagcatggatactctccggagattcttgttatcttcacagagcttccggaaggaaagaccatcaaaacagaagaaaaacatattgcaaaaaatgataagatggctgaaatcgtgtaaggataaggtggacaggaacagatgaacaaagagacatatttaacagaatatccgaagcatgaaagtatgagggagaatgtaaaaaaagataaaaacagacttcactttcatatgatgccgccgacaggctggatgaatgatccgaatggtctgtgtgaatttcagggtgtgaatcatatttatttccaatatacaccatttcttgccggatggggaacgaagctttggggacattacacaacaaaggattggattcattataaagaagaagagccgttcctttatccggacgaagaatgggacagagacggtgtatatagcggatcagcctatacctgtgaagatggaattcactatttttacacaggaaatgtaaaactctgggataaagattatgattatatcatgaatggacgggaacagaatacgattcacgtattcagtccggatggaaagaatattgcatacaagaagcttgtaatgaccaatgatgattatccggtgaatatgtccaagcatgtcagagatccaaaaatctataaaaaagacggccgttattatatgatccagggaggccgtgatgcggaatcttatggctgtgcacttttgttttgttccgacgatctggaacactggaaatggtacgatacagtgcggacagcaaagccatttggttatatgtgggaatgcccggatctgttcgagattgacggccagcagattatgacatgctgtccacagggagtagatcagaagggatatgattaccagaatgtgtaccagtgtggatattttccggtagagtttgacctgaagaacaaatcatacagctttggaaaatttcaggaatttgacaaaggatttgacatctatgcgacacagacatttgcagatgaagcgggtagaagaatcctgattggctggatggggattccggatgcagattatgataatgatgcaacggttgcatatgactggatccatgcacttaccatgccaagagaactggaatggaaagatggaaagatcttacagcatccattaaaggagatgaaagatctgcgtaaaaatgcatttacctgcgaactggaagcatttacaaagtgggcgcctgcggactgctgttttgaactgagacttgacgtggaagaagcaaaaaatctggagcttaagcttcgtgaagatgttacaataagctggaaggacgggctttttaccttatcgatgggagaaagcggacgtggaagaaagcagcgctttgctaaggtggaagagctttcggatattaccatcttttcggatacatcagccattgagatattcattaataacggggaaacggttctgacaacaagagtatatagtgaacatcttgaacagaaagtagagcttgtatccagagaggtaaagggaagcgttcatggatatgaacttggatcattcgaggttgaatataaaaaatagattccggactgcataagatataacaggtgaatatacggaaaagaaaataaaaatgtggacaggttcctgaaaaaagaggtgccagtccacattttttataccatagtatgcaagagatgctgtcagtggcaagttttatgtattgccatgcatttgtaagaagtagcaggtggcaagttttttgtatctgactttgtactagcatattagcaaagagaaaattgcaaaatgtataaaacagagatattattataaaataagaatctgttatggaagatgtgaaatatcagataacaggatatatggagtgaaggtggttatgaaaagtaaagacagtaagatttctaaaatagtaagaatgctgatgatgcttttaacagtgatcctgatcgccctgtttttgacgatcatgattctggtcagtaagatacaagggacggcgcgagtggtgaattatgcaggcctggtccgggaaagacccagcagatcatcaagctggaggatgcaaaagaaccgcaggatgagatgattgcatcggtagcctctttcatgtttagatgtacaacagatgagaatttaaaataatttatagagcattagaagggaagaaatcaaaactgccagtaaggattctcagaaggtttaaacaggaattatatgattttaccgttactaatatgccgacggcaagtatgcatgttgcatcaattgaagatgacagagttaaagacgaagaactagtaatgtcaatgagttggaaatagttttaaaagagatatttgaaaaagatatatatgttcttcaaaattcaattccggcagttagaacaaatgtgagaaggttgattttgatttatgattatttgaagtggggaaaataaaagaacttcttgactaaagcatctgcccccttcccagtgcgatttgggaattaacaggccatatcctttagaggatggggtggataatgaagagcgcagacaagaagtacatgacgtattgcacaggaacacccagagcttgcccaacggtttaaggaacgcagacatcgtttggatgaacatttgaaagaacgccgtccggatgtttatgagcttgtcattagtttaagagataacaagaagaaagaagaataagataaaaaagaaatggttggaattttgaagttccggccatttctttttataaattttatgcattgatacaaggacgaagcataattttagctgtaaatattccattatcatacgtgaaatcacatccaccgccagtcttttcaacaatgtggcggacagattgaattccgatgccattttgatttcttttagaagaaagaaaaatgccatgattctgctggattttaccatcaaaagcattttcaatttgaattaaaataagattagaagcatgtcgatagattttgatatcgatccgttgtctgaattttgcggtcttcaagctggcttccaatgcattttctaacaggttagaaagaacaagacaaaagtctgtttcatcgactgaaatttgtgccggaagatcaatctgcacgtggaaaggaattgtgttacgttcagccagtgcacaataatagctgattacactgtcgatgacctgattttcacaaaaatgcatatgcatagttgggattttctgggttacattatatagatactcttttattgtttctaaatctccggcttcagccattgaggataactgaagaaaatgatggcgcatatcatgtcgtgcctgacgtgtctcttcgattgcattgcagaggttagtatatctttcctgttggattgaaagaaaatagttttcttgttgaagccgtgcatttcggtttagactgtttgccattaataaaaacagagtataaaataatgcaagaatgattaacagaacaaggctgacaacaatatatatctgtaaaatccgtccggtatataaggtgccatcattgcatttattgcgcgggaaaaactattcacgcaagaaaaaacagcacaaatcgcaagaaaaatgctaaaagatttccaaatagaaatcgcaagagttttatgatagatcaccaagaggaacaataacaggaaaaagccaggcaattagctttggaagagatatttttagtgttgattttacaggaagataggcaagaatcatcccagggataattacagtaagttcaagtgtcgggcgaagaatattgttcattatgtatgcccccctttcaaataagaaatatataaaagctttctctcattcgtttattttaacataaaacagatagacaaactatggggcggatttacaattcgtgctattttttgactattcgtgacagagcgattgaaaacgagaagtgtttttttataataaaagcagtagatgacaaaggctggaaaaaggaggaaagtataaatgaaaggaagaaaaatactattagcgtttattatatctgcaattacgctcacatcgggatgtgcaaatggtacatcaaagacagaggaggcaaaatcagagcagaagacaacagaagaaaatgcagttgttccaattaagccgattacggaaaaagcaattgatgataatccatatatggcaaagagtgatgccaatgttcatcaggactgttataattcagatacgacagatgaagtattaccggttgatatttatccggagattaatgtttcttatgaaaaagtaaatccaaatgcatctccggcggtattttttgatacatatggacatgctgttgttccatttcaaggaggactggctatccgtgatattaatgcggatgaaacacagacagaaggttatttttcaccggcaaagcatgatggcggaggatatgtgatacaaagctcatattcatttgtagatgagagcaatcgcctggtatgtccgacaagcaacaaccacgtgcttatgttgaaagcaacagatgatgcgggaaatgtccttccggaatttgaaaaagtgctggatattgatattaaagcagcggcagaagaaattacagggaaaacattggatcagaacttattatctgtagtttttgactatgaaggaaatttatggtttgctacaggcggtttccgtatttatccggaacgtaaacagcaaggtgcaatgggatatatttcaagggcagcaattgatgccatcttaaagggagaacatgttgatctgaaagaatctacatttgtatatgaattggagcctggcgaaggtgcagagaatggaattgcatcgtcaaaggaaggtgcagttatattaacgaatcaaaattgttatttattaaatgcaaaagatggtgtacaggtgcagtggtgtaccccatatgaaagcgtgggagcgaaagacagcaaagagggagatgaaactacaggcggaggtcttgcctggggaggtggatgttcaccatctctgacaagcaaattagttatgtttacagataatcaggatccggtaaatctgttggcattagatatgaagaccgggaaaatagtggcaagcatgccggtaatcgatgagcttccgaaaaatatgcaggtgtcggtagaaaattcagcaatggtatatgataacggagaaggtacagtcagcacaatcgtatgtaactggtttggagccggaagtgctaaacttgcggacgcagacaacgattcttctatacagacctatgaaaatatttacgatgtaaactggttgaagaagggaaataagatggttgtgccgggagtagagcgtgtcgataccattaagacaaaggacggatacgaaatgaagagtatctggtgcagaaacgatatccgtgatacatctatgatgaagctttctacagcgacaggttatatctatggttatgttcaggatctggaaagtggcatgtggcaattcatcatgttagattttgaaacaggagaaacagcatttacaatggatgtctcagataaaccgggatacaacaatatggcaatcggcatgtatgcaggaaatagtggaaatacattatattgcccgacaggatatctggagctcttaagattgcaggacagatttgtttatctgccggagatgccttatcgaaaagtagatttagacaaggcaaagagaaatgtactaacacaagaagaatttacagaagccggcgggaaaggaaatgttgcaggctggctgaatacgattacagtagaaaatgtacatccaaatactactgtggcaatacgaatgaaaggaattgcaggaaaagcagatacatttacattatatgcatatgataaagagaataaattaaaagaagttcctgcagagttatggcatattcaggaagaagatggaacattgccggataaacttacagaggatacattatatgaagtgcatgttatggtagaagatggaggagaatttgatcttagtgatacagaaaaagaaattaagatagcagttattctcggaaataaatgatttgtttttaagaaaatcacctgaggtgtatatcacaaggctccgttctaaaaaagaatggagctttttaaaactaatgcaaagcaaccaccccaaaaatttaacaaaagttaacaagaattctccttcctctataggtgggagatgaattgcagaaaaagaagatagaacacttgttctgtaatgcgaagtgtggtatactacaatcagtcgaaaggatagaaaggactgactatatggacaaaatggatcaaatgcacattcagtatatttgatgtattatcatctgatcatggttgtaaaataccgaagaaaagtaatagatgatccgatttcggaacgtgcaaaagagatctgggaacgtattgcacctgattatggaatcacactggaagaatggaatcatgatgttgatcatgtgcatgttatgtttcgagcacagccaaaatcagaactcagtaaatttatcaatgcgtataaaagtgcaagcagtcgtttgttaaaaaaggaatatccacagatcagggaaagactttggaaggaagcattctggagtcaaagtttctgcctgttgacagcgggtggtgcaccgattgatgttatccgtaattatatcgagacgcagggagagaaaaaaagatgaatatagcttaccattttcgtatatatccaaacagagagcaggaagttctgctcgcaaaaacatttggctgctgtcgttttttatataatcagatgttgaatgataagatacgggaatatgaagcaacgaaaaaaatgctgcgaaatacaccggcgatgtataaaaaagcatatccatttttgaaagaagtggattccctggcacttgcaaatgtgcagatgcatctggaaaaggcatataagaattttttcagggatccaaagattggctttccaaaattcaaatcaaaacacaggagccgaaaaagctatacgacaaatgtggtcaatggaaatattcaggtagaagatcatcagataaaactaccgaagttgaaatggatccgtatgaaaaaacatcgtgatattccagaaaaatattgcctgaaatctgtaacaataagtatggaaccatctggaaagtattatgcaagtctattatatgaaaaaaatgactgtgaaaaccaagcagaagaattagattatgaagacgcaaagatactaggaattgattatgcaatgcatggaatggctgtgttttctgaagatatacagaaggaaaatgaaggatacttcagaaaaagtgaggagcggctggcaagggaacaaagaaagttatcccattgcgtgaaaggaagcaataattattaccgacagaaaaaacgtgttgcattatgtcatgaaaaaatccgaaatcagaggaaagatttcttacataagctgagtcatgaaatggcagagacatatgatgttgttgcagtagaagatattgatatgaaagcaatgagccagtgtatgcattttgggaaaagtgtcatggataacggttacggaaagtttcgggaattgctggaatataagctgacatggagaggaaagaaattggtacgtgtagaccgttttttcccttccagtaaaaaatgctgtaaatgtggtagtgtaaagaaagaactgaaactttcggacagagtatatttttgtacatgtggaaatcggatagaccgggatctgaatgcggcaatcaatatacgtgaagaagcacgccgcatgttgttagcaggataaatgggaagtgtctgtatccagacaatgaaaatatcccataactgggtaaaaatgaatcgcggggcacgcgaggatagcttgtagatacttggctcagtagagccattgagcaagaagccctcacttcaaaatctgtgatttaagtggtgggagcatgtcaccctaaaatggaattattatgatgagtaattatatgaggaacaaaaatgaacatacaaattttcggaaccaagaaaagcttcgacagcaaaaaagctgaacgatttttcaaagagcgcggaattaaatatcagttcgtggacatgaaagaaaagggtctcagcaaaggtgaatttaattcagtatgccaggctgtcggaggatatgaaaaactgatcgatcaggagtgcaaggataaagatctgcttgcgttgattacttatcttgcagaggaagataaagcagaaaagattctggaaaatcaaaaggtgatcaagacaccgattgtgcgtaacagaaagcaggcaacggtaggatatcagccagatatctggaaaaactggaagtaaaagagcattttcatttttcgctgttgtttattgcatatggtgtgaagaatccgctgtccaaagaggatcgcatagatttattcaaacacgaatacgcccattacatgcagtacaatatgcagattcccgaaaagtataaatggaaggcgggaacgcacggaagtgcgtggaaatactgctgttctctaatcggagcggcgccgacgccgtattataaggcgggcgaagcgcttatgaatcatgactacgataaggtattaaagaacaggattcatgataagtccgtgccggtccgggatacttatcagcaactgaagactgcacagaagaaaaaagatgaggtggttcagtataagcttggcgacgcagtgacacatccgaaattcggacatggaattgtggagaagattaatcagagatctggcggggtgcatttacatatccggtttgatggagaagtgaagtgtatcgatcagaaatggttgtcgcggaagaagtatatgtgaaaagattcaataaaaacaaataagcaaggtagtgaagtatctgaagaggataaacgtacacgaagaacgttagaagatgagatgacatttttcgtgtgcgtaaatttatatattgacatactatcaaagcgatactaacataaagataataatataggacaaaaaaagaaagaggtagtaatcatgcggaaaaaatcagaaatgcaaaaggctaacaaagaatttgtaaagacttacgatgattcaaaatatccaaaaccatccgtgactgcagacattgtcattttcggaatgtttgataaagaagaagataattatagaaaaatagcagagaaagagttaaaggtacttttaatccagagaggtgcggcaccatatgaaggctgttatgcccttccgggcggattcgttggtccgaaggaaaccatcggtgaagccgcagaacgtgaattaaaagaagagacaaactgcaactgtaatttcctggagcagttcggtacctacagcaatccaaaccgtgatccgagaagatgggtgatcagcaatggatacatggcacttgtcaatgccggacaggaaatgatccaggcaggagatgatgcttcggatgcaaagtggtttgatgtgtcatttcaggaagaagccggtatatggaatctgtgtctgacacatggggatgagaagcttcatgcaagattagaagagacaacttcgaagtgggatgtaaagaagaaatttaagactatagaaagcgatgaccttgcatttgaccacgagctgattcttgcagatgcaatcgtacagcttcgcaagtggattacggagacgcatatagcgttccggcttttaacggagaagtttacactgagagaattgcagcagattcatgagacggtgctggatacgaagctgttggttccggcgtttcgaagaaaagtggctgatctggtagaagataccggggagatgactggggatgccgggcatagaccggcgaagttgtatcgggagagacgctaagtgaatgcctgtgaaatgaaaattgaagcttgtcagatgaagtgttctcgttgccgaaaagaaggatataagataaatgaggaggtacagagaaaatgaagaataattcttttttatcgagtgaagaaattgttaaaagttttttgtcatatttggatgattctatatatagttatgcttatttgttggatggctcatggggatctggaaagacattttttgttaaggaaatacttattccttcaatagtaaaacatgaaaaagaaaagaaagatcaagactcagaatacaaggaaaagagaattctgtatgtatctctttatggaataaaagaaacggaagaaatttccagattattatatttggaattacgaaaagttatggcagataagatgacaacaggtagatttttaaagaaacacactcctcagattcctacatggttgggcactacttcaaaaattgtgtcagatgttataaaagattcgaagggaattgatatagaaaacatcattaataaaatatcaacaggcttttctttaaaaaactgtatttttatatttgatgatttggaaagaacaagttgtaatgttaatgatatcctgggatatattaataattttatagaacatgatcaggttaaagttctccttatcgctaatgaagctgaaattaatacagcttccagacttgatgcggacccagaagaattattagtatgtcttcaggataatttggattttggctttttagaatcagaagaaaattctggatataatggaagtcaaagtactacaagatcagaaaaacagaaaatatcgcttcaaaaattaatgaaacgagtagaggttgtatttgctcggaatcaggcatataagcaaataaaggaaaaagtagttggtgaaacggtaaaatatcaaccagagtatctgaaaatgataaccaatctaattgaaagaaacttaaataatgacgaaaaattgagagaaattctactcaataaagcaaataaaattgaagaaattgcagaatattatgaacattttaatttgcggacatttcttttctttttgtcaaaagtagtaactctttatgattgcttacagcaacatgtagaaactttcgaaaagatgattgattatatatttttgatatctgtgaaatataaaactggaaaagaaatagagcaatgggaagaaccaaaattatttgagttgaggtcattgtatggatggttcgactttagaaatcaatgcttagcgtttaagtttgttgatgaatttgtgttatatggcaagttgaactcgagggaaattgttgaaacggttactttgtatgaggaatttgagcaaaaaaatgccgagagcgaaaacgatccggcgagacaaatacaaagttggggaagtatggatgagaaaaccgtcaaggtgcttatggaagagattattttgaagatgggcgaagataagtattcgtttgctacatatctgaatatattacataattttgttgctttggtgtctattggttttgatgaagcttttttaaaccagcttgtggaatatatgaaaaataatattagaaatgcttctgaaagaatagaattacaaggaggatatagtttttttataaatgaagatgataaaaagctttatgcactaaagagcagagaattaaatgttgaaatagaagaaaagaataacagttatcaagaaaaagagatggaaaagatgttagaagatgtaaattcatgggggataaatgttaacaagtatgttacggaacatagaaaagtagtacctaaaagttttatttctaaaatggatccaggcaggattctgacattaatagaacaaagcaatactgaaaatatcgaggcatttagatatgcaattaatgatctttattcattttcaaatatatcagatttttatatggaagattatgaaaatttaaaaactatttacgaaggaataaaaccagatgatcaacaatatgacttgattaaaaagaaaaacgttgaattgctaaaagttatcattggaagaaaaatggaattattacgaccgaaatcaatagatggaaattaaaaagaaatgttgtaaatgtcaatattagatataaagatcgaaggagaaagatatatgcatgcaaatgacgaaattataagtcttgccgatttccgaaaaaaattaaaaaggttccaggaatgctatgatgaaatatattttcgaggagaggtagaagaatttccaaatcgagaaccaagtattttgcgtgatgaaggatatctggaaaacgaaggatgtatgtatcaggaaatgatgcaaatgtatggtgaacaaatgaagaatgcatatagatatattggaaaacttgcactgcttcaacataataatgttccaacaagattgctggatataactgtcgatccatttgttgcgttatattttgcatgcgagcagaatggtatagcgaatgacaaagacggatatgtgtttatgtatatcagaaatggaaaaagttgtaattcacccgatgtatatatattatcccttcatgcctgcttcccagagctttcgtataaagaaatagcagagaaggtttggcagaaattgaaggtgaattacacagaagatgaaattcagaaagttattcatacaccgttatttgtaaaaagatcagaggatttaagtgtgggaaatgcaagaattcaagcacaagaaggatgcttttttatctgtgcagatgatgaaaaaggtggacttattacgctggattcgatcccgccggtgatggtttatcgaataccggcatcttataaggccggcatacgggacgaactggataaagaggagaagattaacgtgtgttccatttatccggagatgccgtctggtggggcatatttaagagcaaagtacagaactgtcagatacgaagtgtcagagaaagattatacggtatatgatatatcgcagaaaacgcattgtagaagggacacggatttacgcattatcgtgaaagaagatttgccgataaagtgggtgaagcagatcgttcgacatgtttgtgaggggtataaaagttcttcggatgttatatggatatatgtcggagtgtcgaaggaagatatgctttcgtataactggcggattacgggcaggtggattaatccattatggaaaaatacgggaattgatccgttaaaagaaagagatggagaattttcctgggagaatcaatccggaacttcaattatatcggagtataatgagaaaaatgtctataaaccggacgatgaattatatgcatattatcatcaggtttttgaggattccatgccatatatacgagaaataatttctttatatgatagtgaagaaaaagaaaaattatatacatggatatctagaaatagggaacagattcgggaattttttaataaaaccaccaatggtggctgctcaagaatccgggaatggaatgaatttataaaacattatagcttgctgtatgtagagatggagaatatatgtcttgaaaatgaaaataaaaattggaatcctcaggcaaaatggcatttaatggggaggaggattcaatccattcagaaggagaaggcggttattgaaaagggagaagtaaagtggagaaaaacgctggatgttacggatgaagaactgaaaaagtgtaagccatgctatgaaactcatcaggtaagatcattcgctcagacaatccctatgagtgaagatgccatagaagtcaagatggagattaagtatgagaaaaatacagaaggaaaaatagttgtttccggtaaaaccaacttgtttgacggagcacaattgatgatttcaatcattccagatggaaaattttatggtccgtcttgcaaagtaaactgtttaaatggaacatttacttcagtacccttaggaaatggaacgaatctttcggggaaatgcagattgagtattacgatgcctgtaagttctgtacaaccaatagaatttgtaaaaaaggccggtatgcagtatgaaaacctgaaaggggactttatcgtccgggatggaatatccccttcgggaaaatatgaacaggaagtgattttatgaaatggagaaaatccttatacgacataatcgaagtagccgatgaacaaaatacactaagcaagctatatgactggatgatgatgatcgtcatagtagtaagtattattccgcttgccgttagaaacgcaaatgaacttacgcaaatgttagattttgttacggttattatatttatcatagactatattctaagattattaacggcggacctgaaattgaaaaaaggaaagaaatcatttgccgaatatccgtttacaccaatggcggtaatcgatttggtatcgatccttccatcagtaacgcttttgaacagcagcctgaagttattaaggctcttccggttgttcagaactttccgggtattccgagtatttaaagtgatcagatattctaagagtattaatatcattatcaatgtattcaaaaagcagagagaggcgttgctggtagtaggcggattggcgataggatacatagtgatctcggcactgatcatgtttaatgtagaatcggcaacatttccaagcttttttgatgcggtatactgggcgaccgtttcgctgactacggttggatatggggatatctatgccgtttcaacgattggtaaggtgattacgatgttatcgtcggtatttggaattgcaattgtggcattgccgtcaggcattgttacagccgggtatatggaagagattaataaagatgaatctttgtaatttaggagaattgcagatggaaaataaagagaaaaagcaaatgcttacaacggagctaacaaaagaaaagagcggagggattgtcgggataattcaggatattacaataaacggaagcaaactacatctcgctcagaacggaaccggcggcccggtcatcttctggggcatgtatccacatcagcagaacgaagtagaacatctgtgggagtctttactggaacttgtgccggaacaaaatttcctgctcgtcgcatttcaggtggaagactggaatcgggatttttcgccttgggaagcagcggctgtattcggaaaggaaggcttcgccggacaaggtctgaagacgctgagatggctgacagaggaatgtgtgccacatattgaccggacttttggtgtgaaagacagggaacattggctgatgggttattcgcttgccggattattcgcgctatgggcagcttatgaaagtgacgtgttttctggaattgtatgctgttcgggttcgttgtggttcccggactgggatcattatgtgaggaatcatgtgattcagagtaaatgtagcgtgtatctgagtcttggcgggaaagaagagaagacgaagaacaaagtaatggcagcggtcggtgacaggaccagggcgcaggaaaggctgttacaggaggactcgatggtggaatccgtggttttagagtggaatgcgggagggcattttgcagatgcggggaaaaggctggctaagggcgtgaaatggatgtttggagtgaaaagtggcttataatataagttgagggtgttaaggtttcatggtatcataatcagtatagaagtagattagaaggtgtaatatatgggaagatttgtgaatccggataacagtgcatttcaagtagcactgaattcaaaaatctatatagataaaacgggcttaattgcctgcatgaatgatgtactggactcaacagacggatatatttgcaatagtcgtccacgccggtttggaaaatcatatgcggcgaatatgcttgcagcatactatagcaaaggtgcagattcggaagagatgttttttgatcttgagataggaaaaacagaagattttaagaagcatcttaataaatatgatgtgatccatatagatgtacaatggtttctgaccaattgtgaagaagcagaaaatgttgtagcatatattaccagcatagtattggatgaattgagggaaatttatccggaaattttgtctgaggatgtaagatctttgccggatgggctttcacgggttaaggataagacaggacagaaatttattattatcattgatgaatgggatgtgcttatccgggatgagtcggcaaataagaaagtacaggatgaatatatccgtttcctgagaagtatgttcaagggaacggaacctacgaaatatatccagctcgcctatcttacaggaattttaccgataaaaaaagaaagaacacaatcggcacttaataatttccgtgaatattcgatgctgaatgcgggaccactggcctcttatgttggattcacagaggaagaagtaaaagaactttgtgaggaatataaaaaggattttttagaggtgaagcgctggtatgatggctatcaattaggaaaatatcatgtctataatccaaacgcagtcgtaaatctgatgaccgatggaaattttcagagttactggtctggaacggcttcctatgattcgatcgttccattgattaatatggattttgatggattaaagactgcaattattgaaatgttgtcgggggcagcggttgaagtggacgttgcttcatttcagaatgacattgcgaatattgtgaataaagacgatgtcctgacgtatttgattcatatgggatatctgggttattcgggcgcttccagaatggcgtttgtaccgaacgaggagatccggcaggaactgattcgtgcgacgcggagaaaacgatggaacgagatgttacttttccagcaggaatccgaattgttattagatgcaacgttagatatggatggtgaagcggttgcagaacggatagaaaagatacatgaggaatatgcatcaacaattcaatacaataatgaaaattcacttagcagtgtgttggcattggcatatctgagtgcgatgcaatattattttaagccggttcgagaattaccgacaggacgaggctttgcggattttgtgtttattccaaaaccagaatataagagtgattatccggcgcttgttgtggaattgaaatggaataaaagtgctgtgagtgcattgcagcagataaaggatagaaaatatccggattctattcaagattatacaggtgatattttgctggttgggattaattatagtaaaaaagataagaaacatgagtgtgttattaaggcgtataagaaaaaataacagtgtttcgtcaggcatataagtgaaatgaaagcatagtagaggtgaataaaatgctcccggcaagaaaaatacattttgaagcaaaaaagaaagaaaaagagaacttaagattccgaagcttcttaaaatgcaatgcggatgaagaagaactggaccagcaatttttacaactgcacaaagaattatttgaaaacttcgattgcggcagatgccgtaactgttgtaaagagtactgtgcggaacttacgacagatgaagtgaaggaagtggcagagtatcttaagatggaagagccacaatttgttcagacatatctggaaaaagatgagacagaagggacttatttaacgaaaaataaaccatgtgattttcttcaaaagaatggagaatgtcttttagaggagtgcaagccggatggctgtaagaagtatccatatacggatcaaccgggacgtttggggagtttgtatggtatgcttgatgcgatagcggtgtgtcctgtagcatatgagatctgggaacggttaaagaaaatatataactttcattgatgataatataaatggaatgataaagaggtaattacaaccggaggtgaaaatcaatgaacaaagcagacaaagcggaatctcttttccgtacaggctacaactgtagccagtcagtctacgcagcatttgcggaagagctgggaataacagtagaagaagcagcgaagaaggcaagcccgttcggagcaggattcggcaagcttcgtgaagtatgtggtgctgtgacggggatggtcatggtgatcggtgatctgtacggatacgatgatccgaaagatgcggcggggaaaaagaagctttatgcacttgtgcagaagctttgcggagcatttgaagaatcggaaggaagtctaatttgccgggaacttcttgggctggagaagggcgaagatctggaagagcctgcggtcagaacggaagagtattatcagagcagaccgtgcgtgaaagcatgcagaagagcagcggagattctggaagaatatatgaagaataagtagaaaaagacagcaaaaaatcggggaatatataaagaataaaaggataatagaacgattgatgttgaatataaaaaacagagcggtacgatgaaggtaccgctctgctttatattctgaatcgccatgcgttcgtaagaagttgccagtggcaggaattgttatgtattcgtaaagtctggttgggggcagattccgcagacaatgaaggattttaaaatttctcataatgaattttctcaaatggaagctttgaaagttcggcaggtgttttctcctcagccggcatccccagagacagaatcgcttcaagcttatacccttccggaaaatgcagagattcacgcacataatcttcggttgtaatagatgcagtaccggaatcggcggaagttgcagttcttaaccgtccctggatccaacagcttccgataccaagactgtcggccatcagatgcatatttgccatggcgatggagctgtcctcaatccatacatcagagacttcggcattggcgatgacgacgatggctgcatctgcgccggccaacatccaggcggcgccggtacggcattcggacagatgacggagcatgtctttgtctttgacaacgatgaattcccatgggcggatcgaacggctggaagcggacagaagtccggcctgaatgatctgtgtcaatgctgcatcatcaataggtgcaccggtgtatttacgaatgctgtggcgttgctggaaaattgataataaattcataaaaaagacccctttatattttttcttatagtataattgagaatataagaaaagggaagagaagagtatttagacaagtattagacaaaagaaagcaggaaggatatgagcgaatacattacgacctacacaggaaaacattttaaaccaacagaaccggatccggagttatttgacatagcagatattgcacatgcgctgtccctgatatgcagaggaaatggtcatgtgaagatgttctggtcggtcggggaacattgcatttgctgtgcaaaagaggcaaaggcgagaggtctgtcggataggatggtgcttgcatgcctgcttcacgatgcaagcgagtgttatatgtcggatgttccgtcgccttttaagaaggaactgccggaatataatgaacgcgaagaacgtatgctttctatgatttatgaaaaatttctcggttcggacctgacaccggaagagaagatgcagttgaatgcgattgataaggcaatgctatggtatgatctgacgtttcttctgggagagaaacaggagagcgaagcgcccgaattgcatattgatctgaggtatgaggtcagagcatttggtgaggtggaagaggaataccggaggatttttgaagaacagcttataaccgtacagaataaaagaatctaaaatcgtacggataagatagaaaaggaggaatacattatgttacacgaagtatcttttgcgtcctacaatggacgtgaccaggtccagggatggatctatgttccggcttgcaaaccgaagggaattgtccaggtgatccacggatttggggaacattccagacgttatctgcatatgatatctgccttcatggatgcgggttatatcgtggcagcagacgatcatgtaggacatgggaagacagcaatggtcaataatgtgtggggcgactggggagacaaaggaccgcatacaatgatggaagatgagcatacattgaaaggaatcgtgtgtgaaaaatatccggatctgccatatttcttattcggacacagcatgggatcttttatcacaagagatttcattgcaaaatacggggacgaactggctggggcaaccatctgcggaacaacgggaatcttccgcggggcagaagagacgggaaagaaattaaaagaagcgatcgatgcaggacatggagaagaatccgatccgtcatatagcggagaactgatgggatggatgtgtgagcgttgtggagaggtcagcatcggaaatgagtggatctgtgccgatccgtatgtacagcgggatcatgccgatgatccgtttgatgcatttaccagaccgaccagcaaccgttcggtatatgatttcatccagatgatgttacagatcgagggaacaaagtgggccgaaaaagtgccgacagacctgccaatctataatattgcgggagatcaggatccggtaggtgagtatggtgtcggtgtatatcaggtaagtaactggctggtacagaccggacataacgtaacaacgaagctgtactcgggataccgtcacgagatacataattatgctgagattaagaacgaagtcgaagcgggtattattgcattcatggacaaggcattataaaaatgtattaggtgccgggagggattataattcaaaaaaatagagataaaggcataaaaagtacaatagcatttttgattttcagggactccggttttactaaaaccggagtcctttttgaagaagttcatcgaaagagcaaggttttccccacagatatccctgactataatcaggatccatcagccggatcttttcccattcatcctcagtctccacaccttctatgcagatttttatgttcagacggtgtatcatagtgcagaatcgttttaaaagatcatattcctttgcatcttttatagcttttgcggtaaaggaacggtcaattttaatgatatccggacgaagttcattgagataatggaagttcgaataaccggttccgaaatcatccagtgcaagccgtatgccggcttttcttaattccttcaggaaatgccgtgcattggaattgtcttccagcaaagcactttctgttaattccacgatcaatgcttccggaggaagtttggcattttcaagttcagcagagatatcctgtatcacatcagacttttcaatctgtatctgtgagatattgatgctgacctggaagtccggaattgtttcacggatctttttacatgcctgtagagcttcccttatgatccagcggccggccggaatgatgagtccgctttcttccaggatagggataaattctgccggtgagatagttccgaactgtccggaagaaaaacgcatcaaggtttccgcaccaaaaggctgtctgcagcctgatttcaccaatggctgtaaggcaacagagaatccacggaagtcatgtatgactgccgcatgaaggacatcgctgatatctttcagatgtaagaaccgttgatagtcctgttcattgaaaatgtaataacggtttcttccccgttttttagctgtgttcaatgaaaaatctgtccgcttcatcatttcatcatattcattttccagaagattataaaatgggagaatcccaccggaaatcgtaaaaattgccgtataatgattctttttaataaactggttgatattttccctgattttattgtaaaggtgtactgctgtctgcttatcgtcagaagtaatatccacgatgataaattcatcagaggataatttgtatacctgctgttcccctgaaatacagtgcgaaatacactctgcagtttttcggagaatataatcaccataatcccatccgaatttttcattgattgatttgaaattatcaataccaaggcgtaacagaaatccattttccagaggagtctcctgggtcttcaggtattcaatcagaccattctcgccgaaaagtccactgatattatctgctttctgcttttcgccgatctcattaatacatccaaccatgtagagcggcttctgatgatcatcccgtacaagatatccgcggcagttgatccagaccggattcccgttcagatccagccagcgatattccatattatggatacaacggttggtagtaagcagatcacggaattcggcagtcagcagcggataatcctcggcatatacaaagtcccggtgtgtttccataacattataaaaagcattttgaggaacgcagaaacgttccagtgactgtggcgcaatatagtaaaagtcggtccggaaatcaacgaagtacagatagtcatcggtacttggactgagcaagtcaatgatcccgcataattccgtcggtgaaatatgctggtattttttctcctgcgtgatcagttcatccgtgatcccttgtgcacgagattgctttccggaagaaagcatcggatgagaagaagcggaatgtgatattttttttcttcgtttttcacggtaaagcatagtatcactgcgtcttacgatatctttaaaatccatatcggtgtcaggctgataataggcatatccggaggagacgctgagagaataggaaagatcctgatccttttcatttagaagcagctccagtttatggatcttatcggcaatcagctctttttcatctttatggaaaatataagcaaattcgtctccaccgattcggaaacaattttgttccgatggaaaagcctggcggatacactgatagcaaagctttaaggcttcatctcccttttcgtggccaaagttatcattaatttccttcagattatcaaggtctaataagacaactccggttgtatgtaattccagctcctgctcgtccagataacggatcatattttcataggcattccggttcatggcttcggtgagcatatctatatttgccagtttctggaagtagatcagtttttgcttctggatacactgttcataatactgcgatacctgaatccagatcagcataaggataaacagcagggtcccaagcggaaggaatatagatgtctgctggaatctgcggatataataaaccaatagttccgataaggaaaaacacataatgaggtacattggatatctgaactttctggcaagttcgtttccaagctgttttgcctcgtaatggatcagtccgatcgtatatgctgcattcacaaacatgatcagatgcgtgatcggaagaatcaggaagatatcgacaattcccatacactgaagaaggacggctgcgcccatattgatcagataagaaacagacaggaacagggcacctttttggaatttacttttgcaaatatcatacaaaaggaaattaaacggaacaggaaagagataaaatgtaaagaagtcaataaaatacagtgttcttccatccgggactaaaaattgcaggaaaccgcattgattcagggaccataaggcaatcaacagggagaagattccaagattcaggaatattttagatgtttcttcggaaaaatcctcctgtttcttacgaatcactgcaatatacaataccagagagagaaatccaaaaaataaaacaccgcaactgaggatcagtattcctagactctggctgagaatcttcagaatacaatcgcccctcgtacccagaaaaagatgcaccggggttccgtaataaccctgatatacaggaatgattttgacggtcagtttcttggcgtcactgtttgccggaatgtctacaatatgccagcagaagccgggtgatttcatgaatttgggtgtgtgtttttcatttccgtattgataaataagtttcccatcaagccagacttctgcattggtatgagtagtctgaaaaagaatcgctttttgcgagtggaattcatcggacaggatcacagattctgttttcgcaccgtcagttttaaaacttgttgttttcagtgaggtggtgttatcaaaaggcagttcgttccgaacagtatcctgtctgaatatccagatggaaaagataacggcaaataagacagatgcgatcaacgagagccatatttttttctctattttcataatttgatttcctttagattctacgtattctcaggtgacaataatctatacgtatagaataacaaaattggcagatgaaatcaatgtgaaaaggagcttgctatttccaaacttttgctttacaaatgatatataaagtattatgataaaaaaaaacgaaatcttcagggcagggtgtgattccctaccggcggtaaagcccgcgggccgagaggcatgatccggtgtgattccggagccgacagtatagtctggatgagagaagatgatggtacagttattttaatagatgaatgtagtgtctgagctctgagatggtgatccatttcagagcttttttggttaacagatcatttgtcagttacatgtaacagatcatttcccctgtaggtatcctgcaggggtttttgtataactaagaaagaaggaagaaaaatgacggatcaggaatacatgctccgggcaattcagcttgcaaaaaagggagaaggatggacgaatccgaatccgatggtaggtgcggtgatcgtaaaagacggccggatcatcggggaaggttatcataaaaaatgcggagaacttcatgcagagcgcaatgcaatcgcatcgcttacagaatcggcagagggtgcgacaatctatgttacgctggaaccatgctgtcattatggcaagacaccgccgtgtacggaagcgatcatagaacagaagattaaaaaagtggtgattggttccagggatccgaatccaaaggtggcaggaaaaggtgcacagatattgcgtgaatcgggaattacagtagttcaggattttatgcgggaagaatgtgaccgtctgaacccggtgttcttccattatattacgacgaagacaccgtatgtagtgatgaaatatgctatgacactggatgggaaaattgcgacaaagacgggtgcatcgaagtggatcacaggagaaccggcccgacaggaagtgcagcatatgcggcaccggtatatgggtattatggccggtatcgggactgtacttgcggatgatccgatgttgaatgtccgggtagaaggatggaaaagtccggtcagaatagtatgcgacagcagtcttaggataccgcttgacagccagatcgtaagaagtgcaaaagagtaccggacaattgtggcttatgcaggacgggaagggaacgaagaaataacagaaaaaatagaacggttacatgcgaaaggcgtggatactgtctgctgtccggatgaaaaaggtcagatagaccttaaaaagctgatgacatatcttggaaatgagggcattgacagcattctgctggaaggcgggggcacgctgaacgacagtgcactgcgggcaggaattgtaaaagaggtacactgttttatcgcaccaaaattatttggcggaaagaacagtaagacaccggtgcaaggaatcggcatcggacttccatcagaagcattgaaactgaagtgtacggatatctgccggatcggtgaagacatcaggataatctgtcaggtatgtgaaaaagaacaggaggggccatgtttacaggaatcgtagaagagaaaggatcggtccgctatatgcagctgaccggagagtcgggagttctggcagtcaaggcgaagaaggtattggaaagaacgaagatcggtgacagtatcgcagtcaatggagtgtgtctgacagttacatcacttcagccggatggatttactgcagatgtgatggcagagaccatcaggagaagcagtctgggaagttgtaaagtcggaagtcaggtgaatctggaacgggcaatggctgcagacggaagatttggaggacatatcgtaagcggtcatattgacggaaccggtgtgatccggtctctgacccgagaggagaatgccatctgggtatctattggaacatcgccgcagatattacatctgatcgtagaaaaaggctctatctgtatagatggcatcagcctgacggtggcaaaagtagaggaagagggatttcaggtatcggttatcccgcatacaggagaagaaacgacgcttttggaaaaagtgccgggcgattcggtgaatctggagaatgatgtgatcggaaaatacgtagaaaggctgttaggccttggaaagagtgaagaagagaaaaaagaatccggaattacgatggaatttttgcaggaattcggattttagaacaggaggataaatagaatgtcacaaaacaatcagtacaatacaatcgaagaggcactaagggatctgagggaaggaaaggttattctggttacagatgatccggacagagagaacgaaggggatctggtatgtgcagcagagtttgcaacacaggagaatatcaattttatggcgacttatgcgaaagggcttatctgtacaccgatgagcgcggaaattgcagcaaggcttaactttccaccgatggttgcggagaataccgataatcacagcacagcatttaccgttgcagtggatcatgttgatacgacgacaggtatttcggcagcagaacgttcctatacaatcatgaaatgtgtggatgaagatgcgaagccggaagatttcagaagaccgggacatgtatttccactcattgccagaaaaggcggagtcctggtgcggaacggacacacagaggcaacgaccgatctggtgagactggctggattgaaagaatgcggcgtgtgttgtgagattatgaaagaagatggcacaatgatgcgtacaccacagttgtgggaacttgcaaaagagcataatcttacatttattacgatccgtgatcttcaggattacatgagaatccatgaaaaacatgtaaaagaagaggcggttgcagaccttccgacgcagtatggagatttcagacttcacggatatatcaatgatattacaggagaacatcatcttgcactggtaaaaggtgatatcggagacggtgaagatgtactttgcagggtacattcggagtgcctgacaggtgatgcatttggctcgcttagatgtgactgtggtctgcagcttcagacagcgatgcgtcaggtagaagcagaaggcagagggatcattctttacatgaggcaggaaggcagaggaatcgggctgctcaataagatcaaggcatatgcactgcaggagcagggatatgatacggtagaggccaatgtaaagttgggatttgcaccggatctcagagagtactggatcggagcgcagatattatcggatctcggagtgaagtcattgagacttctgaccaataatccggacaaagtctatggacttggtgggtttggactgaagatcaatgaaagagtaccgctggagatcccaccgcagaagtatgatctgaaatatatgaagacaaaacaggaaaagatgggacacattttcaaagaaatagaattataaaaagatttaatgaataacaggaggaagaaatcatgagacagatcaatttagtagaaggaaaagtagtagcacctgagggaatgaaagtcggaatcgtggctgccagattcaatgagatcattgtgaataagttattgggcggagccgtcgacgggctggtaagacatggggtagaagaagagaacattacggctgcatgggtaccgggagcatttgagattccgctgactgcacagaagatggcacagtccggaaagtatgatgcagtcatctgcgtgggagcagttatccgcggggatacttcccattatgatctggtgtgtaatgaatcggccaaaggaatcgcgcaggttgaacttgcaacaggaattccggtattattcggagtgatcacaacagagaatatcgaacaggctatcgcacgtgcaggaagtaaagcaggaaataaaggatatgactgtgcattgtccgcaattgagatggtaaatctgatgaagcagctttaatcaggtgcagctgatggtgaaaacaatcatttttgattatgatggaacgatacataatacccttggaatctatgagccggcgttcagggaagcttatcagtggttggcggagcagaatgtcgtagaggaacagaagatagagacggcgcagatcgcaggctggctgggcttaaacagcaaagaaatgtgggatacatttctgccggaattagatcagagatacaaagatcgggcgagtgcgatcgtgggagattccatggtcaggcagatcaggaagcaccgggcagtgtggtatccgggagcggaagagatgcttacagctttgaagaacagaggatatcatcttgtgatcttaagcaactgtaaagtggcataccgcaaagcacattgggaagaattccgaatggaaagatggtttgaacagttttatgactgtgaatcgtatggtttctgccctaagacggagatcgtgcaggaagttatccgggactatccgggaccttatctggtgatcggagacagaagacaggatttggaatgtgccagatcctgtaaaagtccgtttatcggatgcctgtatggttatggtgagaagggagaactgaatggagcagattattttgtgaaatctgtagaagagataaccgaaattatataatgtgaaaaaatgcataaaaatagaactgtatttttgtaaattatgtttaattccactcttgcactttacaagaaaaaagtgtaaaacattaagtaagctaaaaagtaaataagaaatgcaatgaaagggatacgtcataaaagttaactggaattcagagagccgttggatggtgtgaaacggcagaaagtattttatgatatcacccaggagcatcccgctgaaatatacaggttggaagaatcaacatagtcaggtatcgagtaagccgggacgttgtcttcacgttacagaagaaactgttagatattttgacagtaacaagtggttgtggttagtgatgactgcagtaaaacgaagtggtaccacggaagaatattccgcctttgttatccgaaaggatagcgaaggcgtttttttatatatttactttaaagagaaagaagagggattgttttatgagtggaatattaatgatgatcattgccattgttgtgcttggtggagcatatcttctttatggtcgttatctccagaacaaatggggcattgacccaaatgccaaaactccggcatatgagatggaagacggggttgactatgtaccggccgatacgaacgtcgtattcggtcatcagtttgcatcaatcgcaggtgcaggtccgatcaacggaccgatccaggcagcaatcttcggatggcttccggtacttttgtggatcttaatcggaggggtattctttggagccgttcaggatttcgcatctatgtatgcatctgtaaagaataaaggacgtacaatcggatatatcatcgaagaatatatcggaaaattaggtaagaaattattcctgttattctgctggctgttttgtattctggtcgttgcagcttttgctgatgttgtagccggaacttttaatggattctcagtaagtgaagccggaaaagtaacaaaaattgcagctaacggtgcagtcgcaactacttctatgatatttatcttagaagcagtcggacttggaatgtttttgaagtatacgaaattcaacaagtggattaatacagcggttgcaatcgtattattggtagcagcaatcgcactgggacttcacttcccaatgtatgtaggactggatgcatggcatctcatcatcttcgtttacatcctgattgccagtgtcgctcctgtatgggcacttcttcagcctcgtgattatctgaatagttacctcttgatttttatgattgttggtgcgattgttggtgtatttgtagcaaatccatcttgtaaccttcaggcatttacaagctttaacgtagatggacagtatatgttcccaatcttatttgtaacgatcgcttgtggtgcggtttccggcttccattcactggtatcttccggtacagcatccaaacagattaagaatgagaagaacatgcttcctgtatcattcggagcaatgttaatggaaagtatgcttgcagttattgcgctgatcgcagttgcatcttttgctaaaggtgaagcagcagcacagggactgacaacacagcctcagattttcgccggagcgattgcgaacttcctgtcagtcatcggactgccacactctcttgtatttacgctgatcaatctggcagtatccgcatttgcattgacttctctggattctgtagccagagtaggccgtctgtcattccaggaattcttcctcgatgatgatgtagatcaggataacatgagtccattcttaaaagtggtaacgaataaatactttgcaacggttattacactggtacttgcatatttcctgacaaaagtcggttatgcagagatctggcctttattcggttcagccaaccagctgttatctgtactggcactggtagcttgtgcggtattccttaagaaaacgaagcgcaagggattcatgctctggggaccaatggtattcatgatggctgttacatttacagcacttggtatgacgatcgtgaaactgacaaaagcattcctgacaacagggctggatcttggaaatacattacagctgatttttgccgtattgcttctgatccttggtgtgttggttgcaatccagggtgtaaagaaacttcttgaaaaaacagatgataagaaagcaacagcttaatcaatattttattcgtaataagaacatataagagaaactgtggtaatagcgtgaaggttattatcgcagttttttatttaagttatagcagataaaaaaagaacaaatgttctgaaaaccacttgaaaacaagaacgcttgtttgtataataaaactatgaatatagaaatcaaaaacagtaattatacaacacaggagaaattacagattctcgctgatgcggcaaaatatgatgtggcatgtacgtcaagtggttccagccgccgtggaaagaaaggagaactcggcaatacagaggcatgcggcatctgtcacagttttgcagcggacggaagatgtatttctttattaaagattctgatgacaaatcattgtgcctatgattgtaaatattgcattaatcgtgcaagtaacgatgtgaaacgggcaacatttacacctgaagagatctgtgaactgacgattgagttttataggcgtaactatatagaaggtcttttcttaagctccggagttttgaaaaatccgacatacacgatggaaaagatgtgtgagactttactgctgcttcgcacaaaatatcattttaacggatatatccatgtgaagacgattccgggagcttcggatgaacttcttgccgcagcgggatatctggccgaccgtatcagtgtgaatctggaacttccgacggaagagagtcttcggactcttgcaccgaataagacaatgaagacaatccttaatcctatgggaaaggttcagaatacaattgctgcacaccggatggccattggaaagacagcatatatggaaagaagcaggggaaatcaactgttaaataacggcattttttcggaaatatccaaaaggaattatcgggaaagcctggaagaaaaaaagaagacagacagactgtcggatggaaaggacggaactttgccttctcaaaaagaaatggggagagtggatggactccttacatgggacaatgcatatcagttagcaccccatgatatgtctggtttaaagcgtcgttttgcacctgctgggcagagtacacagatgatcatcggtgcgacgggggaaagtgactatacattattgcagacgacccagcagttgtatcagggctttgatctgaaacgagtgttttactcagcatatattccgctgaatgaggatgatgcactgccggggcttggaacaccgacaccgcttttgcgtgaacaccgcctctatcaggcagattggctgcttagattttatggattccaggcaggtgaattattgtcggaagaaaagccggatttcaatgaactgatcgatccaaagtgtgactgggcattacgccatctcgaacaatttcctgtggaaatagagactgcaagttatgcaagactgcttcgggtaccgggaatcggtcccaaatccgccagccggatcacacatgcaagacggtatggaagactggattttgcaagcttaaagaagatgggtgtggtacttaagcgggcgcattattttattacctgtgggggaaaacagatgtatcatacaccggttgaagcatcgtatattatgagacaactggtgagtgtagataagaaagatgtatggaatatagaacattccaatgaatcttatgtgcaattgtcgttggcagactttgggatagggtaggaaattatgaagatatatacttgtaaggatcgtctggaggacattatgacctgcatctatgatgcctggtcggaagctttacgaatcggtcatgatcagatacaattaaagaaagaaccgatattacagcagacaatgtttgatgaatatgtccatgtagacggggataatgtgaaagcagaaaaagtaatccgttctgttcgcagggatatttccgatgaagcatatctggatgtatattatgcaaccctttctgcggaggaagatgcgttacaggcaatctataattttctgcgtgtcggatttgcagtgggaagtaaggtactggaacagtattcgaatcctcatgtgatgcgcatgttggaacttcggcggaaagtcggtaatgaaagccatcattttaatgaatttgcacgattccagtcgttggacagaaaggtctatgtcagtcatctggaacccaaaagtgatgtgatcatgctggttggcagacattttgcggaccggatgccatcagaacattggatgatcatagatgataaccggaaaacagcatgcgtacatccaaaagacggaacaaactatctgcgttatctgacggatgacgaatttgagtcacttcgtaaaacagaacagtatgaagatgaatatacagagatgtggaagacgttttttcaggcggttgcgatcaaagagagggagaattatgtgtgtcagcggaatttgttcccaatctggaagaggaagcatgcggtggaattcagaacgctaaggatatgagcataaaaacttgcgaatcctgaaagaaatatctgtcaggaagagaatcattgaaaggggaacaaatcaatgcagcaaaatttaaaagtgttaatgttaaatggaagcccacgggctaatggcaatacatctgttgcattaaaagaaatggaacaggtatttaaagataacggaatcgagacagagatcatactggtcggcaataaagatattcgaggctgtatcgcctgtggttcctgctatgagaaaggcaaatgtgtattcaacgatatggtaaatgaactggcactaaagtttgaagaagccgatggacttgtcgttgcaagcccggtatattatgcgtcagcaaatgcgacactgattgcctgtcttgatcgtttgttctacagcagtcattttgacaagacgatgaaagtcggagcaagtgttgtatgtgcgagacgcggtggttgttcggcaacatttgatgaattgaacaagtattttacaatctccggaatgccggttgcatcaagccagtattggaacagtattcatggacgtatgccgggtgagtcagagcaggacggagaaggaaaacagacgatgcgtacacttgcaagaaatatgacattcttgatgaagagtattgcgcttggaaaagaacagttcggattaccggaaaaggaagaacgaattgcgacacattttatacggtaagagaagtggagagaagaaaatgtcagataaacgtatttttgaaagatttgaatttagaaatataaaacaggatgaagcagaagaagccgcagagatcgaaaggatctgttttccaccgaatgaagcctgttctaagaagcatatgaaagaccgtgttgccggaattgcggatttatttctggtagcgattgataaagaaaatggaaagatggcaggttttttaaatggactagcaacggatgatgagatattaaaggacgagttctttacagatgccagtctgcataacccggaaggcaagaatgtcatgcttctgggactggatgtactgccggaataccgcagtcaggggcttgcaagagaactggtacgccggtatctcgaaagagaatgtgggaggggaagaaaagagattatccttacctgcctggaatcgaaggtagcgatgtatgagaaattcggatttaaagataaaggaatcgcgcagtcaacctggggcggggaagaatggcatgagatgggtgtaaagaatcagaattagaacactgggaaaaatgtatcagcaagagaataaataggcaagaatacgggaggtacaatgtgagcaaaatagtaaatataaattccacatcaacaaaagaagaacagttaaaagacctgataacatccatccaacaagtaaaagattctctggtaaatatactggatgaatatgaagaagacggtgaagtggataaagcagacactctgacggaagcgttggatgcattggaagatgcatacgatgtggttaatgatgtactgttagatgactaataaaataataaaaaatagtctggaagctatagtctgaaatcagaaaagaatccctgagatcacagtaaaacgacaaatgacggtgatttcaggggttttttgctatgcgtttgaaaaagctgttgttggcaattttaacaaaaatatcattccttttacgaataaattcgctcagattcttgacgatttcaccaaaaaagtgtaaaaatagaaaacgttattgaaaaaaacataaggatagaatgaactaacaaaaacaatacaagttgtgctatcaagatgtacttggaggaagcagacaatggaattaagagacaagatcgcaggagcattatatggaatggcattaggtgatgcgatgggcatgccggcagagttgtggggacgtgaaagagcgagaaagttcttcggaggaaaaatcacaggatttatcgacggaccgaaggaaaatgacgtcgcattcaattacaacaaagcgcagttcacagatgatacaggccaggccttggtacttctggattcattaaaagcgacagattataaaccagatgcggcagacatcgcaagacgtatgttagagtgggcagagaaggaaaatgcatttgaaaataacattctcggaccgacatcaaaagtagcattagcgaatttccgtgacggcgtggatgcaagtgcgattacaaataaagcgttatccaacggaagttctatgagaattgcaccgatcggatgcttatttacaccggatcagagaaccgaactgatcgattatgtatacggtgtgtcgcaggcaacacataccagtgatgtaacaattgccggagcagccatgatcgcagaaggcgtggcatctgcaatcgtaaatgatgattttgagcaggtattaagcgatatcctttcggtagaagaagccggatatgaaaagggatgtgagacattcagtccaagacttgcggaacgtgtgaagatcggtgtacagattgcaaaagaatatgcagatgatgcagatgcattttcaaagaaaatctatgatgtgatcggatctggtgtgggaatcattgaatccgttccggcggcaatttccattgcgtattatacacgggatccgaatgaatgctgcctgatgtgtgcgaatcttggaggagacacagacaccatcggagctatggcaactgcaatctgtggggcatttaccggatactccaagatcaatccggaatacacggaacttttaagagtacagaatccggagacggatttcgcggaatatatcaatattcttgaaaagggaagggagttgtcgggatgcggacgttagtagtcggcgcggcgatcgttgatcttatgatgaagatcgaccggcttccgaagagtggggaagatattccatgcagggagacaaagactgtagtcggcggctgtgcctataatgtggcaaatactttgcgaaacctgcaatgtgaacatgatctgtgtgtaccggtcggaaccggatcatttgcagatatcatccgcagaggaatgaaagaaaaaggatacgaaccggtgatcgaagaaccgggtgaggacaatggatactgcttaagtctggtagaaacggacggcgagcggacatttattactgttcagggagcggaatgccatttcaaaaaagaatggtttgaccggattgacatgagcagatatgagaatatctacattgccggttatcaggtgtgtggaaacagtggcaggattatcgccgactggctgcagaatgtaccggatgtagataaaaagaagatcttttttgcgccgggaccgatgataacagagatcgaacctgagacgatggaaaagctgatggcattaagtccggtgcttcatattaatgaggcggaggccaagaactacgccggtcgggaacaggtagaagatgcagtgaaagatattttcgcaaaaagtcagaataccgtatttgttacactcggaagagacggaacaatgttctatgacggaaatgtgatggagaaagtggcaccgttcaaaacggaagttgtagatacagtgggcgcaggtgatagccatatcggcgcagtgatcgcaggactttccaagggaatggaagtaaaagctgcagtaagacttgccaaccatgtggcatcagcggtcgtgggtacattcggaccggttatggattacgaggaatttcaaaagatttcggaggaatgggaaaatgaataaaatcaagaactttttttcagattggagctggaaagaaaaaacgtggctggcattcgtgctgatcgtacagacagttgcatggggcatccagaaggaaagcgcattcatgctgatcatgacactgacaagcagcctgaacctggtactgggagcgaagggcaaagtggctggtctgtactttgcaatcatcaacagtgcattgtatgcgatcaattgtatgggaattccgctttacggagaggttatgtacaacctgatctactcgattccggtaagtgcgattgcaattgtcacatggaagaagaatatgaccaagggcggagaagttaaattccgtaccatgacaccaaagattatgatcacaacagcagttgtaacaattgccggtgtattaggttacatgcagatcctgaagtggttgggcggaaatcttccattcatggattccctgacaacggtagtatctgtcgttgcaagtttcctgtatttgcttcgtttctctgagcagtgggcaatgtgggcaatcgtaaatgcattgtcaattgtgatgtggatcatggtatttatgcagggtgattcatccgcacttctgattattattatgaagtcgattaactttatgaattctacatacggcttcctgaactggagaaagattgcgaaggaaaatgcacagtaatatagagtgaatgaaaagtttaatcccccagctatgctgggggagaatagttttatattgcaacatggaagttatgtttcgcgactctgaatatatttcttatattcttcttcagaccagcgccggtattcggcagcttcgtcgtttttaccctgcttttccaaaatcttagatttgatatcataaagccagtatttccggcaattttcttcaccataatattcatattcataagtaaaagcctgctccaacgcattcgtagcttttgtgcagtcattcaaatcaagataggcttctgcgatacagatataggcaggtacacagataccaatctcgttaatcagcaggaaacgcctgatggcttcttcataatattgaatggccttttctgtctctttcatcttagtcagcacactggcactgttgaaatatgcccaggcgatcagcacattgtcgtctgaaagcgtttctttacggagatgcagagaatgttcaaaataagaaaaagcctgttcaaagtcatccgtatgatattttgcccatcccatcatagaataacttctggagagctgctgcttcttttctaaagaatccggaaggtctttcagtagggaaagggacaacgcagcttcagaagaaagtccatcatattgttcaaggcagcgcagctgatttgaaatgtagtagtgataccagctggctttcagtggctccggattcagcgtcagaagccgtttcatgatggcaatacttttgtctcgtataaaatattcggcataagcttccgcaagatgttccatgaatggaatatcaaaagagcgggatggactgcaccatttcagatagtaagcttccgcaagtgagagcagggtacgcttttccgttgacttcaaatgtgtaaaagatgagagctgtctggtcagattctggatataaatctggcagtcatctacaaaatcaggatcatttttctgaatggtattgacgatgagcggatgcagggatatcacatcggtaatgtaattatactggataaaactggaatcaatcagttcatctatcaacataaaatcatctagttctgttaagtcaaaaaaagtctctgtttcaataccttctaccggaagaagtgccatatttttcaagatggagagtttctcttctgtaaggctgcccaggtggaacagatctgtcattacattcaggatatgttccattactatgtgagaacgtctggaggcaggagtttcttttctattgaaaaagtccagcatactggcaggggacattctggaggcttgcatttgtctggccagaagttcgatgccgtaggtgtgatgggcaatcttatcaaaaatctgcaagagaatcatatcatcaccagactgtagagggcgtttataaaatttctgaaacaaagcaataagatcttccggattgtccattggatgaatggaaagttcctgatatccatctttttcatgactgatacgggtagtgaaaattacagaatatggtccctccagaagttcctgtgtgcgttcatcttcggcatcaaaattgtcgatgataagaagtgtatgtttatcacagtgttcttttaaataattcagctttttataataataagtttcccgtgcctgaggagttgtaaggtcttgtttctcattttccagaccatggatgagaagaaactgatctgtgatgatcatatcttccagcgtactgttgtaagtgaaccagagaatggttcggtattcgttctgaaatttcagtccatattgtctggcaagttcactttttccaatgccaccggttccgcataaaaataatttattgttgtcgctatgaagtaaacggtatatttcgttaagttcagatgcccggccaacaaaatttgtgttgtgtacaagggtggtactgcgtatgctctgaacctgaacgaccggttgggcattgttgttccattcactgctttgaatccaataagaaattctggatacaagggcattgatacggtcttcttctggcggttcggtaccatccagaaaatgaatccgtccaaggtaataccggacatcatccgatatttccctgttatcggttcggaaaggtaacaggcggatggattcatgttgatggaaccggttaaaagcatagtcaatttcattgagtacatgggcagaatgagaagactgctcattcataaccagaaggaagacttttgcatgtattgattgctttaacaatatctccggcatagtttgaatctacatcccgtggggcataccagcatttgattccgtgactttccagtgccgctacaatatgttccacaagttcagcagatgagtttcggtgataactgataaatacttcgtgctgcataaaagcacctcgtttctgtattgataataattctattttagcatatgacaaacaacggggaaactgtaaaaacggtgaaaccaaggaagtgggacattgacgtcccactccttttgatataaactattatctatatgtctatagcaaaatatagacgttatattatagttaaaagagtaaggagagtacatacgaatgaagagtttttatgagtggtacagaaaacacatcaccggtgcgattttcggcggattgatcctcggaatcttgaccggactgtttttggcgggacggtttaaagtggttctgactgcaacgagtgtactgggaagcatctatatgagtgcattgaacatgatgatcttcccgctggtattctgttcgatcgtaatgggtattgcaagcatcggaagtgccaggacgacaggtaagatcacaggagcggcaatgctgttcttcctgtgcaccacagcgctggcaagttttgtcgggctgatcattccgagactgatccgtcttggaaaaggtgtcagctttaagatggctacatctgatattcaggcaacaaagatggacagtatattagatacagtgaaaggactgattccttccaatccggtgtctgcatttgcagagggtaatatgctgcaggtgctggtatttgcactgatcatgggatttacactgatcgcgatcggagaaaagggagagccattattaaaggtaattgattcttgcaacgaagcatgcctgaagattatcagtacggttatgtatttcacaccgatcggagtattctgtacgatcgttcctgtcgtagaggcaaatggaacaaagacgatcgtatcactggctacacagctgatcatcttatatgttgcgttctttggatttgcatttgttgtatatggcggtgcagtaagcattttcggaaagacaagtccggtgaagttcttcaaagcgatcatgccggcagcattgaatgcatttggtacatgctcaagttctgcaacgattcctctcagcaaaagttgtgtggaagatgagctgggcgtaccgaatcagatatccagtatcacaattccgcttggagcaactgttaacatggacgcagtatcaatcttgatgtcgtttatgatcatgttttttgcaaatgcatgtggcgtacatgtcagtattccgatgatgatcatcatccttctggcgaatgttcttctgtcagttggaacaccgggaatcccgggaggagcaatcgcatcgtttgcggcactggcaacaatggcaggtcttccggccggagtcatgggtgtgtatatcagtatcaatacattatgtgacatgggagcaacctgtgtgaatgtaatcggtgatatggccggatgtgtcgtactgaaagagaagatagagattgaaaaataaaatggaaattacagaaaaacaaaatagattaacgaggacctgggtggttgcagctctggcgtgtgtctgctgcatcttatggggcagcgcaattccagtgatcaagacaggctatcgcatcttatctgtagattctgcagataccgcaagccagatcgtcttcgcaggtatccggtttgcattggctggaattctggtattagtatttgcatctatccgtgaaaaacatatagttcttccggatggaaaagtatttcgctatgcaattcctgtctgttttgcacagacctttgtccagtactttttcttctacatcggagtagcacatacctccggtgtaaaaggcggaattatcacaggtcttggaaattttatcgcaattttaatggcatgtctgttagtaagaaatgaaaagatgacaggcagaaaacttgccggctgtattctcggatttgcaggagtcgtgatcatcaacatggcaggcggttctatggatatgggcttcagactgacgggagaaggctttgtgctgatcgcacagttgtcctatggagcatcgaccgtactgatcaatattttttcccaaaaagtatcaccggttatcttaagcggctgtcaattcttcatgggtggagtgttgttgtttgtagtaggaatcctcatgggtggacatctggatcatatgtctgttgcgggagcggtattgatcctgtatctggcgatggtatcggctgtagcgtatacactctggtcagttctgctggcacataatgaagtgtcaaaagtagcaatctttggatttgtcaatccactttgcagtgtggtgttatcggcactggttcttggagaagtaagccaggcatttaatgcgagaagtctgattgcattgattctggtatgtgtgggaatttatattgtgaattacaaaaataaaaagtagatttcgggaaatatctttttgaaaaacagtaatgaaatgtaaataaagtaagaggctgagaagttctttctaaaaagaatttttacagcctcttttgcatgtcagcgatatagagtttacaattttccttccggaatcttactgataatcgtcttataaattctgatcaaaaatgccatagacgcaataaatgatatcacttccgcaatcgggaaagaccaccatacaacgtgcagtccgccgatcttagacaggatataagcagcagggatcagtacaaccagctgacgcatgatagatacgatcatgctgaatactgctttgccgagtgcctggaatacggtaccggcaatgatacagaaccatgcgatcaggtagtggataccgatgatacgaagtgccggaacaccaatcttcagcatgtcagcagatgcattgaacattccaagcaatacctgtgggataccctcaaaacagagaaatccgataaaagtaaggcagaatgcagttgtcagactgatcctgatcgtccggatcatacgctttctctgctgggcaccgtagttgtaagcaatgatcggtgtgataccattgttcagtccgaataccggcatgaagaagaagctttgaagcttaaagtatacaccgaatacagcagttgcggtagaagaaaactcgatcaggatgcggttcatcgaataggtcatgattgatccgatagactgcataataatagacggaataccaactgcataaatgtgtccgatcaggcttatgtccggacggaatcctttgaagcttaaggacacttcatggttatatttgtgattgcaggttccggctacgatgccggctacgcactgtccgatgacggtggcaacggcagctccggttactcccatcttcgggaatccgagaagtccgaagatcataatcgggtcaaggatgatattggtgatagcaccgcataactgagaagtcatactgaagatcgttcttccagtagaagtcagtagtcgttcaaagaaaatctgtgtaaacaaaccaaaagaaaagatcataactgtactcaggtaatcaattccgagattcatgatctcgacatctgcatttccaatctggcttgcatagaacggttttacaatcgtaaagccaaggattaaaaatacgatgtaactgatggcatagataaatgctgcattatcagcaatcttattcgcctttttaaaattgcgctctccaagggacttggacaggagtgcattcatgccgacaccggtaccggtagctaccgcaatcagaagtgtttgaagcggaaaagctaacgaaacggcagtcagcgcattttctgataattttgctacgaagatactgtcaacgatgttataaagtgcctgtaccaacatggaaatcatcattggcagggacatgttaaatactaattttccgacgggcatggttcccatcttgttttctgctatgggagcagatgattgattttcactcataaatctctttcctccacagtgacgccgcaaaccagagcgtctattcatataatttcattctctttgttatcagacccaaaattatataataacatgaataggggaaggattcaatcatttgaatgcaggattgggcgatattcgtagctcggtataaaatccttcttatcatataacgtatcataatattggaagatacgatccattacttttggaatctgtgtctcatccggttcatacagaatgagcagatactgcatggaactgtagcgggtactgatgtctaccttgcggattttttcatgaatggcttgttccatacatgcaagggcatgttctctgttttccgtatatgtgacagatccgggtgcggtgtcaattgtgaccattataaggaaacagtgatgtttatagcgctcattgagatggttcatgtattcataaatttttgcaaattcccggtaatcaaggttcagggcaccattgtaacggccactttcgctcagagcatgggcaattaatcctagatctttgccggtcacttcgtcttcggaaaaatccagttccatctgctgatagaagaagaatccctgctttccgttttgttttacatgatagagtgctttatcggctttggagtagcaatcttcaaaaggttcgccctttgtactcaggtataatcctgcggagatagaagcatattggatctcagggtcttcggatttggcatgttcgaatttttcaaaaagatcctgaatgaatgctgtcacctgttccttgtctgtttcaggaatgaagagcaggaactcatcaccaccgagacggcatacggcagaattctgcgaggattcagcaagaagcgtaccgagaactttcagtgctctgtcacctgctttatgtccatggatatcattgatctttttcagattatccatatctatgaagatgaggcatccgctatattgctgcatgaattgtgcagtaagcttttcacctctgctccgcatcggaagcccggtgaggaagtcaaagctttcactgtcttcctgtgtctgtatcgtagacataacattagaaacgaaattttcaatctcattttcaataaatggaagttcaggatcatcctctgagaattcacagtgttcacagatatggactctgtcatcgaaaagcagttccaggaagatatctgcaagatctggatcaaactgaagtcctctgttgttctgaatttcttcaaagatcttttccggtggaagtgcatttcggtagatcctcttggaattcatggcatcgtaactgtcggcaatagctacgatgcgggcggaaagcggaatgtcctctccggcaagtccgtccggataacctgttccatcataatgttcatggtgtgaacgggcaacttcggcaacatgagggatcagagtaatattctttagaatttcggcgccgataacggtgtgttctttgataacggaatattcttccggcgtaaggcgggcaggcttgttcaaaagcatatccgggataccgattttaccgatgtcatgtaagtgtgctgcatatttcagattcatgatctcttcggaattccatcccagttcaccggcgatcagagcggcatattcagcaacacggtgagagtgtccgcgggcatattcatcctttgcttcaatcgtagtagaaagagtctggatcatctgaagggatactttctcaatctgacgtttccgtttggccagttcttttttctgacgccggagttccatcatatgtatattttctgcggtgcgaagcacatttaaagagaaaagaatcatcataccgattccgacaaatataccggagagagatacaacaaaataagtagagatcccttcgatcatgacagagatagtagcagcaagcagtccggtgaatgcaagcagattccggtgctttttttctttctttatatccagtgcaaatgtgaacagcactacaaataccgtaagaaggaggatggtatgagacacaaaaagcgtctcgatataatcagcaattcctgtaagatgcagaatggtactgatgatgaaattaaaaattgcaagccatcctatcggaagatagagcctgcggtattttctatgctgtacctgatcggcataaaagagtaccggaagaggggagagcatgagaataataaagcacagagtggcaagtgcggaggagtgcggaaccagaagctggcgaaattttgattcgccgagcatccagatcgatcccataagcatgcaccatccaagatattccatgtcgaatttggtatgatagataaatccgagcatgatactgaagataatggttatcacacttgcaaacaacaggaaaaatgcaatgattgtttccataccgtattgtgtgaacaggaattcccatatatcgatcttatcaccgcaatataccgtattgacaacaccggagtattgtttggtattggtgcgtaattcgatacgcagttctttaccggcatctgcatcagatgtcttacagaaaacataacggctcgcagaatttttgcctgcaagtctggtatctttggtgtcgtattcggaacgaagtttcccattaatataaaagcgtacactctgtaaagaagaacggacagctaaggtattactgtcgtaatcttccggtaacgtagaggtgattatcatagtatcttccggtgatacggaatatcatccaggaacggtaattttttcggaactgccgtcggatttctgccaggtgaacgaaccatggtaaactggcataccggacacttcatttatgtctctttcgttggtcccgaatgcctgaaggatgagaaaccagacgagtatgccggacataagaagataaaataaatatcgtatttttgtattttgtatgtatagttcttttgtcatgtcagtcctcctggaagtacgatgtggttacagttcaaaaaagtctttgatctgcttcagaataatgtccatcagtcgtatgcgcgcctcaatgccggcccatgcgatgtgtggtgtaattaacaatttgcggctgtctttgatctgaaaaagtggattctgctcactcatcggctcctggcataagacatccagaccggcggcagcaatctcatccgttatcaaagcatcatataagtcctgctctacaacgatcggtccacgtccgagattcaaaaagatgcaggattttttcatctttgaaaatgcatctttatctagaagattttcagtatattcattcaggggagcatggacagagatgatatctgaagtagtaagcagtgtatcaagatcaacctgagtgtatccgttctgggcaggttgtccggaagcagaataatagattacatgagcgccaaacgcctttgcgatctgggcaacacggcgtccgatagcaccaagcccgatgatgccccatgtcttgccgttaagttctgaaaaatgttctgaaaaatgagtaaaacaggtatcattgatataatttccattttttacataatcgtcataataacgcagcttttcgagaagatagaaaagcatggcaaatgtatgctgggttaccgtttcggtggaatatccggcaacattgcgccaggaaatgccgcgggaagccagatagtctttatccagattattggttccggtagcagtaacacagacaagcttcaaatgcgctgcggtatggattgtctgttcgttaacaggaactttattgataatcagaacgtctgcgtccctgacccgttcaggtgcttcttccggtgtggtaaagtcgtatctggtgacctccccaagtgcgtcgaatccggaaagatcaatatcatcaccgattgtttttgcgtctaaaaatacaattttcataataagttcatcctttcataatgaaatcactgctttaccggatacagatatataccatataggcagcatataagataagcatgatgattccttccttgcggttgagttcttttgaagtccatgcgaagaacagagttatcacactgatcacgatcaggacagcaatgtcgatcatgttatcccaggcgaaagccaccggactgattgctgcggcaacaccgagtacaagaagaatgttaaagatattggaaccaatgacatttccgagcgccatatcgacttcatcttttctggcggcaacaatggaagtgacaagttccggaaggcttgtacccatggcaataatggtaagtccgatcaatgtctggctgagtcccaggcggactgcaatcgcagaggctccatcgacgacaaaatcaccgccgtacttgatcgcgatcatacctccaagaatgaaaatgagacatttccatgccggaaggagattgatatgtgaggtaacctgttcaatctcttcttcagaaagagagattctttcttcttgtatagaagaaatagcatcaggtgttgttgtacggcgtgctcttttgactgagcggatcatccagagcagatatccggtaaatattataagaaagagaattccatcgattcgtccgagtgtcatacccagatatccaagcaacagtaaaagtcctgcacagaagatagataatgggaattctttctgtaaagtacttttctgaacggcaagcggaacaaataaagtacagacaccgcatactaccagcagattaaaaatattagagccaaccgcattgctgatggcaagggaattattgccggtcagggaagcagttacactgactgcacattccggaaggctggtacccatggctacgatggtcatgccgatgatcatggaagggatccgaagccgctttgctacggcagagcttccttctacaaagaagtcggcacctttgattaacaggacaaatccgacgattaatataatgagtgattttaataattgcatgtgattctccttttttccatctttaaatagatattaacggccggcaaaggctgtctccttgtaattgtatcataaaatcaaacaaagaggaaacaagtgccagtgtcaatgtatataaattattctttccaaacgcacggatttactgtatatttatatggaaaataaaacaagaaggagaaatacaagtatgttaagtatggtcattgacagcatcagttcattcatgtacagtaaattgctggtcattatgttaatcggaactggtgtgtattttacgatccggacgaaatttccgcaggtgcggctgtttcgcagcgcctgcaaagcggtaatggagaaaccggatgatgaagatgcagtctcttcttttcaggcactgatggtctccactgcatcgagagttggaacaggaaatatcgtaggcgtatcgtctgcaatctgtatcggaggatttggagccgtattctggatgtgggtgatcgcaattattggaagcgcatctgcgttcgtggagagtacattggcgcagatttataagaaaaagggtgaggacggaacatgttacggaggaccggcgtattacatagaggctgcacttcggtgcagaccgctggcaattgcattctgtattgccatgatcgcgacatatgcatttggatttaatatgctggcatcttataacctgcagtctacatttgcaggattttctttttatcatgcagatgtgacaccgtggatcatcggaggtattctggcagttctgacaggatggtgtctgctgggcggcggttcacgtattataaaagtaacttcgatgctggtaccggttatgggtgtggcatatattgtggtggctttgatcgtggttgtgatcaatatcagatatattccagatgtgtttgcaacgattttcagggaagcatttgactttcaggcaatctttggtgcatttgccggatctgccatgatgcagggaatccgccggggattatattcaaatgaagcggggattggttctgcaccaaatgcggctgcatcggcaaatgtcacgcacccggtcaagcagggactggttcagatgttatcggtgttcattgataccttattattatgtacggcaaccgctatgatgtgtatgtcatccggagtagccccgtcggaagcattgcagggagcaccatgggtacaagctgcattgcaggaatcactcggaacgtttggtccggtatttattgcagtgtctatggtattatttgcatttacaacactgctcggtaattgcttttactgcgacaatttgctgacatatattcataaaagtcagcctggacgacatttcatgatggcattccgtgtggtatgtgcgcttgttgtattcatgggagccgggatggagatgtctatgctatggaatatcgcagatgtgttaatgggagtgatggcgatcattaatatcccggtgatcatcctcttatccaatacggcacggaaagcactcgatgattatgaaaaacagctgaaaaagggtatgaatccggtatttaagagtacggatatcggactgaaagagaaactggattgctggaagtagaggaggtgacagctatgtattatgtaccggatggaacaaaggaatgcggatattatgaatgtaagaaatgtgggaaccgttttctgtccctgcagacgatgaaacggattccttgtccggactgcgagcaggagatcgattacgagatcggaccggatgaatctctggaagatgtgctggatacggcagaacttctgcagaagatcgaaggcacagaagaagttgcgaagatggatgcacttctgagcctggcgattactggcggggattgtaattggatttaattgggatttaatttatgaacggggaagcggcctctcagtccttgaaggaaacaatagataaggcttcttgttcaggttccataccataagaaacactaagagagtcagaatcacctaaaagcaaaggaactacgctcaaactcggcgttcgcctcaaacacgttcgcttcgttcctttaacggtgcttctgactctcttagtgtttctaacggcattccacattcacaataatccttatctattgtttccttcaagtcgtgactgacagcgaatgttaataaatgaaatgcccggaagtgtaacccggtgtagtccgctacggttacgcaattgccatttagttcttaaggcatttgatacacacgtcctttttgtatacctgtagattctatctactactgaattaactcttccgcatgtttaagtgcggctgatatatttggacagaaattctcacgtccaaccaaatctacgaatccggattttttcataacattcagaggctgtttatttacatgcgagaataccagtgtaattcctttattttcacatacctttgtaagattgaataatgcgttcatagcagtactgtcaattgcaggaacacttcgcatacgaagaaccagacagcgtgtaaagtctttgacaacaatgtgttcgattgcatctgcagcgccgaagaataatggtccggtgatttcgtagacacggatctgcaatggcagttccttcagttgttcatcaacatccggggtgtcatcatctacatagacccagctgtctacatgagtttcttcgctcatacgtttgatgaagaggagacatgcaagtaccataccgatctcaatcgcaaccaccagatcaaacaggatggtcagaaggaatgtggtgaacaatacaatgatgtcgctcttcggagcggtgcgcaccagatgggtgaatgtacgccattggcacatattataggcaacgatgaacaggatcgctgcaatagtcggcatcgggatcattccggcaaatggcatcaggacaacaagtacgatgaccagtgtgacggagtggactattccggcaacgggtgtacgtccgccgtttttgatattggcagcagttcttgcaattgcacctgtggcagggattcctccaaataaagcagaagcaatattacctgcaccctgtgcaaccagttccatgtcggaacggtgcttcccgttgatcattccgtctgcaacaacgcaggaaagaagtgattcgatggcagcaagtacagcaatggtaaatgcatttggaatcgcattctggacaatctgtacattaacctccggcagatggaatgaaggaagggaattgctgatcgtgtaaagattcccaatcgtggagaccttaagcggcaggaattgtaccatcaggcttccggcaataacggcgatcagcgatcccggaattctctttaagagcatcggtgagatgatcaggatcgcgagacttacgattccgacgattaaggcatctgtgtttatcgtagagatattttctgcaaatgctttgagtttttcggtcgtttcgattggttttacgccgtcgggataagttatgccgaagaaatctttcaattgcccgatcacgatcgtaactgcaattcctgaagtgaagcccgttgtgatcgtatatggaatgaatttgatcagacttccaaaatggcagaatcccatcaggatcagaaagatacctgcaaggatggttgaaatcacaagtccgtctaacccgtcttttgcaacgatacctgcaacgatagttgcaaatgcagcggtaggtccggcaatctggacactgcttccgccaagtgcagagatgacaaatcctgcaacaatcgcagtgaagattccggcttccggtccgacgccagatgcaagtgcaagtgctatggacagcggaagtgcaatgattgcgacaatgattcctgcggtcacatcttttacaaactgggcacggtcgtaagatttcagtgaagtcagtaacattggttttaatgagttcatgtgttgattttaccctctctctcttttgtattcctctaatctataaaaacaacaattcagtataacataggaagcaatttgcaaaaaccgggaactgagatgtttatatttatgtacaattccggaaaagtaaaatctccggaaacattatgttagattaaggaaaagtatcggggaaaagcttgaaattcatattctgagcgtttataatatgttgcgggcagttatatgccgcacaaaatagttagaaaataaataataaaattcaaagaaaaaggcaggtgaacagaatggacggttgcgatagtcatgggcgaagtagcagcataggatgggaacaaaaaagtttattaagcaacagtcggttctgttggatgtaagtatcgttgcgatatacattatagatttcttttatttcttatcctatttcccaatgagtatgacaagtgaatagtagcagtcgttgatggaggatatgatcgttacatatcctgcagtgtatttgtggtgaagaaaaccgggcaatctgtgccatggttatatttcacgtgaggaaaaaagggtaggaggtaaaggtatggaaaataaagattacacagttgaaatactggaaatcatcagaagcaatacatcaccggggattatgagaagcagactggaagattatcatgcgaatgaccttgctgaagtatttccgcagctgaagatctccgaaagaagaaaaatctgtagaattctggatctggacatgctttcagacatctttgagcatattgatgaacaggcagcagccgaatatctggatgagatggatatcaagaaagcagcggcaatcctgtctgcgatggagacagatgctgtagtagatgttctgcagatgatgccaaaggagaagaagaatcttctgatagaattaatggatgacgatgccagaaaggatatggcaatcatcgcttcctttgatgaggaggagatcggaagcagaatgacaacaaactgcatcatgatccgtgagaatctgacggtgaagcaggcaatgagcagtctggtagaccaggcggcaaagaatgataacatttctacgttatttatggtaacggaagataatacattttacggagcaatggatctgaaggatctgatcattgcaagaagagaatctccattggaggatctgattgcaacatcgtatccgtatgtgtacggtaatgagttgatcgatgattgtattgaaagactgaaagattattccgaagattccattccggtactggacaacgacaataaacttctcggagtaatcacatcccagagtatgatcgacctggtcgatgatgagatgggtgaagactatgcgaagttcgccggtctgaccgcagaggaagatctgaaagagccattaaaggagagtatcaagaagagacttccatggctgctggtattattaggtcttggaatgattgtttcatctgtagtcggtctgtttgaagaagtggtaagtcagcttacgattatcatgtgcttccagtcactgatcctggatatggcaggtaacgtaggtacccagtcgcttgctgtaacaatccgtgtgctgatggatgagtcgctgaccggaaagcagaaggcagagctggtatttaaggaaatgaagattgcattctcgaacggttcgatcctgggaattctgtcgtttgcactgatcggactttacattgcattattcaaaggaaagacgtttgtattcgcatatgcggtatccggatgtattggagtctcactgctgctggcaatggtaatctcgggagcggtcggaacactgattccactgttcttcaagaagatccatgtagacccggcggtagcatccggaccacttatcacaacggtcaacgaccttgtagcagttatatcatattatggactgagctggatattcctgatcaatatgatgcatctggttggatagaagacacatagcaagagcgaagagaaacgaaaatggacattaaagatttaaaagtatttcaggcaattgcaaaagaagaaagcattacaaaggcatcccgtattctctatatgacgcctcaggggatcagtaagatcgtaaagaacctagaggcagagatgggatgccgtctctttacacgcaataaagccggtatgctgcttacagagagtggaaaacgttttctggaatatgcggataaagatattgcagattattatcaggtgaagaaagatatcctgcatatcgagcagagacagaagaaagtggtagatctgttgtctgcttatggaatcatccgtatggtgacaccggactgtattgcagaattctgcaggagatatccggatatagagtttcattacagagaatatccggatcttcagacagagcatctgtttgcagagaatgaaggaaatgtagccttttctatcggagaatttgatgaagaattatatcatgtggttcctttggagtcattttctgttaaaatgttagtgaatgagcaggatcctttaagtaaatgtgaaagtgttacgatagaagacctgaaggacaggccgttgtatatagagagcagccagttcacaatctaccatatgattatgcagaaatgtaaagaagtgggatttcagccggatatagcattccagaccagtggtttcagcctgtgtcataagatggtgaaagcaaataaaggagtatctgtgacggtggattttgtgtttgacgatatgaaagaatccgggatgaggttgattccattttccgatggaatatatgagtggaaggcatgtatgatcaccagaaaagaagaggcggaaaatgaagcagtgcagtgtttccggcagtttatacaggaatggatcgagaaaataaaacgtggagagattgtacgataagatttgaatcggacaatctgtggatacaggataagaaaaaagttgatagaaggaaactaaaagttgaggataagccatatgtttgacattattaacagataaacagtgtcgaatatatggcttttttgtatagaaattttgaaatatagagagaatgaataaataacaagtattatagattatatcactttaacaaatagattactgacagatataatataaatatatgggtattagggatgcctgagaattatttgtattaggaggaattacttatgaacatcggagtaacagaaatcagcccaagagcggtgcagagagcggcagagaagaattttaaaagcgggtattactgctgcgaggcattgatgagcaccatccgtgatgaatttaaactggatgtaccaaaagaagtcattgcaatgtcatccggtatggctgtcggagcaggaaaatcgggctgtgtctgtggcgcattcaacggaggtctgcttgcacttggattgttcttcggaagaacagagcaggacgggccaaccaatccaaagagcataaaatgtatggaactggttcacgaactgcatgactggttcaagaaagcgaatgggaagaatgcaatctgctgcagagttctgacaaaagaattcaacatgggacagggtgagcacaaagaacagtgtatctttttcacaggactgtgtgcatggaaagtagcacagattgtctgtcgtgaactgggaatcaagaacctggatgaaattgatgaaccggcagaacgtcgtgcaattgcagatatctaggatacatagatacagactagaaaggaagacaagatattatgaaagatgtaatcaaaaaagtaccgattccaatctgcggagtcatgcttggagcggcagccttaggtaatctgcttcagagctattcagaaggaatccgttatgtgtgtggagtgttcgcagcatttctgctgatcctggcacttctgaagctaattatgtttccgggagctgtgaaggaagatatgaagaatccgatcatggcaagcgtatcaggaacatttccgatggcacttatgatcttaagtacttatgtaaaaccatttatcggacaggcggcttattatatctggctgtttgcaattgcattacatatcgtgctgatcatttattttacggtgaaatttgtatttaaactgcagatgccaaaggtattcgcaagttattatatcgtatatgttggaattgtcgttgcatcagtcacggcacctgcttatgagaaacttgcaatcggaagtgcagcattctggtttggatttgtgacactgatcctgttactgatcctggttacataccgctatgtgacggtgaaagaagtaccggatccggcaaaaccactgatctgtatctatgcggcaccgacaagcctctgtatcgcaggatatgtacagtctgtcatgccgaaatcttacggattcctgatgggaatgtttgtagttgcaacggtgatctacatctttgcacttgtaaaagcaatcggctatttgaagatgccattcttcccaagctatgcggcattcaccttcccatttgtcatcagtgcgatcgcttcaaaacagacgatggcatgtgtaatgaatatgggacatccgatgccgttcctgaaatatgtggtattgatcgagacgattattgcggttattctggttgtgtatacttatatccggtttatgggatttatctttggtggaaaaaaataaatagaataataaaaggtggctgcttattgtagggcagccgctttttgtgttcttgcatagccttgaaaaaaaggttatactttataatatgttttttgtctgacatgacagttaataataagatgtatatggaagcatcgataaaccggaattagggaattgtaatttgaagggaaaagaatattcgaggtaacagtataatggtaaagatagatctgatcaccggattcttaggctccggaaagacaacatttataaaaaaatatgcaaaacatctgatcgacagtggggcaaatatcggaatactggaaaatgattacggtgcagtcaacgtagatatgatgctgttaaaagatctggaaggcgagaactgtgaactggagatgattgccggaggatgtgatgcggaatgccacagaagacgtttccgcacaaaactgatcgcaatgggaatgtgcggctatgaccgtgtgatcgtagagccgtcgggtatctatgatgtggatgaatttttcgatgtattacgggatgatccgatcgacagatggtatgagataggaaacgtgatcacagttgttgacgcaaaattagaaccggaattatcagatcaagcagattaccttctggcatccgaggctgcgaatgcagggtgtatcgtacttagcagaagccaggaagcagaagatgcagagatagaaaatacggttgcgcacctgaatcatgcaatggaaaaagtacagtgtaagcggagatttcaaaatgacattataataaaagactgggatacattcgacaatacggattatgaaaagctgttatcctgcggatatgtatcggagaattaccggaaaatgcatatcgaagagggagagatattcaaatctctgtattttatgaatttggataagacgaaagaagagattacagaagcagcagaaaaagtcctggaggacggagaatgcggcaaggtatttcgtgtcaaaggatttctgaaagataaagaagaaaaatggctggaattaaacgcaacgcatcaggagataaggactgctccgattccggaagggcaggaggttgtgatcgtaatcggagaagagatgaatgaggcgaagatacgtgggtatttttcgtgaaaatctcaattcgtcagaaatacaacgagaatgttaataaaataactaaaaatatttgttgaaaaggcacaagaataatgcaaaatgacgaagaaaagtagaggataattgtgtagattggctgaaaaggtgaaaaatgactaaatatcattgaaatgatttgtgcatcatgatatagtaaatgcagttgaacaagcaagctgagataggagagcgaatacaaagtaatcagacgattactttttaggcgcactctttttttttgaaaaataacccagggtgtaatagaataaatgcaaagcataatagtttagcaaagtagaatgaggacagataagatgaatcagatattttatgatgcggttggcaataatccgattattgcggctgtgaagaacatggaagatatagaagtaagttgtacaatagaagagatacaggtgattttcatattatttggagatgtctgttcgatagacaggattgtaaaacgggtgaaagatgccggaaaagttgcaatggtacatgtagatctgatcagcggactcagcccgaaagaaatttcggtagaatatctgaaagaacatacagaagcagatggaatcatatcaacaaagccgtcactgatcaagaaagcaaaagaacttggaatgtatacggttctcagatattttctgctggactccatggcatttgaaaatatcagacagcaacaacatatggtgagaccggattttatagaagtacttccgggtgtgatgccaagagtgatcaaacggatctgtggttcagtgaagacaccgatcatagcaggaggattgatcacagataaagaagatgtgatggctgcattatcagccggagcaattgcagtatcatcaaccaatcatcaggtatggaagatgtaataactatataagaaaaaacagaatatttaattgcctgagggagcaatttaaatagaacgcatgcgaaaaagtaacaagtaaaatgaagcgaaaatcaggaggaaatgaatatggcaaaatatgtaatggcgttggatgcaggaactaccagtaacagatgtattctgtttaatgagaaaggtgagatgtgcagtgtggcacagagagaattcacacagtatttcccaaaaccgggctgggtagagcatgatgcagatgagatctgggcaagtatgcttggtgttgcggtagaagcaatgaatatgatcaatgcagaggcagaagatattgcagcgatcggtatcacaaatcagcgtgaaacaacaatcgtctgggataaagaaacaggagaaccggtacatcatgcgatcgtatggcagtgccgaagaacatcagaatattgtgattccttaaaagaaaaaggattaacagataaattccgtgaaaaaaccggactggtcatcgatgcatatttctcgggaacaaaggtaaaatggatccttgataatgtgccgggagcaagagaaagagcagaaagaggagaattattatttggaaccgttgagacatggctgatctggaaactgacgaaaggtgcagcacatgtgacagattattcgaatgcatcacgtacaatgttatttaacattaatacactggagtgggatgatgagattctggaagaactggatattccaaaatgtatgttaccggaaccaaaaccatccagctgcatctacggagaggctgatccgtcttatctcggaggcccgatcccgatcgcaggagcagcaggagaccaacagtcagcgttattcggccagacatgtttcaatgcaggagaggcaaagaatacatacggaacaggatgtttccttctgatgaatacaggagaaaagccggtattttctaaaaatggtctggttacgaccattgcatggggattagacggcaaagtaaattatgcgctggaaggttcgatctttgtagcaggagcagcgatccagtggttgagagatgaacttcgtattattgattctgcaccggattctgaatatatggcaaagaaagttaaagatacgaatggatgttatgtagtacctgcatttacaggacttggagcaccacactgggatcagtatgcaagaggaaccattgtaggaattacacgtggagtgaacaaatatcacattatccgagcaacactggaatcactggcatatcaggtaaatgatgttcttgttgcaatgaaagcagattccggaattgatcttgctgcactgaaagttgacggtggcgcaagtgccaacgatttcctgatgcagacacaggcgaatatcattaacgcaccggtaaaccgtccgcagtgtgtagagacaacggcaatgggggctgcttatcttgcaggtcttgcagtcggatactgggaaagcaaagaagatgtgatcaagaactgggcaatcgatcagacattcgagcctaagattgatgacgagcagagaaacaagatgatcaaaggctggaacaaagctgtaaaatacgcttacggttgggcaaaagaagattaaaaactgaataaagacagatagaaaaagggggaaatttctatgttaccttatattgctgaatttttaggaacaatgatactgattattcttggtgatggagtggttgcgaatgtaaaccttaataaatcaggaatgaaaggtgggggaacagttcagatcaccatcgcctggggacttgcagttatgctgccggcatgtatatttggggctgcatccggagcatcctttaatccggcactgacactggcgctggcaatcgacggaagttttgcatggtctatggttccgggatatattgtggcacagtttgcgggagcatttgtgggaggtgcagttgtatatcttctgttcaaaggacagtttgatgcaaccgaagaccaggcaacaaagcttggagtattctgtaccgcaccatcggttccgaatcttggtctgaatattttcagtgaggcagttggaacatttatacttgtatttgcaatcaaaggaatggcaaatgttccggaacttacagacggacttggcaaatttattgtatttggaatcatcgtttctataggtatgtcactcggtggtctgacaggatatgcaatcaacccggcaagagaccttggaccacgtctggcgcatgcagtacttccaatcaaggaaaaaggaagttcaaattggggatatggaatcgtgacattaataggtccggtaataggagctgttgctgcggtattgctttttggtgctattccgtggtaaaataacaaaaaatagaacaagaggcgtgagagaagagagcctgacaggataaccgcatattcgtgatgcgtttacttgtcaggcttttttttcaaaaaatcatacagatattagataaggagagataaaaatatgtatgatgtgataataattggaagcggagtctcaggctcggcagcagcaagggagttgtcccgttataaagtaaaggtatgtgtattagaaaaagaagaagatgtctgctgtggaacgtcaaaagccaacagtggaattgtacatgcaggatatgatgcaaaagaaggatcattgatggcaaagttaaatgtccgcggaaatgcaatgatggaacagttatcgaaagaactggatttcccatttcagagagttggttcgctggtaatttgtctgagagaagaagatatggataaattgcaggcattatacgacagaggagtggcaaatggcgtgccgggacttcagatcctgaacagagaagaagtgctcgagatggagccgaatattgtagataatgtatatgcggcactttatgcaccatcagctggaatcgtatgtccatttggattaaatattgcgatggcagaaaatgcctgtgaaaatggtgtggaattcaaatttgatacaaaagtacagagattggaaaaaaaggatgatatctgggaaattcacacgaatcagggtgtattcaagacgaaatatgtggtgaatgcggccggtgtttatgcagacaaattccacaatatggtcagtgaaaagaagatacacatcacaccaagaagaggtgattattgtctgttggataaaacagcaggcgcacatgtgagcaagacaatatttgctctgccaaatgaattcggaaaaggaattctggttacaccgactgcacacggcaatctccttcttggaccgacagcgatcgatatagaagaaaaagaaggaacgaatacgacaagagaaggactggatcaggtacttacaaaagcaggacagaatgtaaaagatataccgatgcgtcaggtaattacttcatttgcaggacttcgtgcacatgaagaaggacatgaatttatcatagaagaagtagaaaatgcgaaaggatttattgactgtgcaggaattgaatctccgggacttaccagtagtccggcaatcggtgagatggttgcggggattttgaaagaaaagcttcatttggaagaaaaagaaaatttcattgcaacaagaaaaggaatcctggatccaaacactctgactaaagaagaaagagtgacattgatcaaagagaaaccggcatacggtaatattatctgccgatgtgagatggtcacagaaggtgagattatcgatgcaatccatagaccacttggagcaaagtcattagacggcgtaaagcgcagaaccagagcaggtatggggcggtgccaggccggtttctgttcccctagaacgatggagatactggcaagagaattggatattccgatgtcagagatcacgaaatccggcggaaaatcccaaattatcacaggaacgaataaggatcagctgtaatagaaaaaggaagatagattatgaaaacatacgatatagtaattattggcggaggcccggcaggacttgcggcggccgtatcagcaagagaaaatgggattcaggatattctgatcctggaaagagataaagaactgggtggaattctgaatcagtgtattcataatggtttcggtcttcatacatttaaagaggaactgacaggaccggaatatgccggaagattcatcaaacaggtaacggatcttggaatcgaatacaaattacatacgatggttatggacatcagctcagataaaattgtaacagtgatgaaccgggaagaaggattatttgaaatacaggcaggtgcagtcatcctggctatgggatgccgtgagcgttccagaggtgcattgaacattccggggtatcgtccggcaggcatttattcagcaggaacagcgcagcgtctggtcaatatggaagggtatatgccgggaagagaagttgtaatcttaggctctggcgatatcgggctgatcatggcaagacgtatgacactggaaggtgcaaaggtcaaagttgtagcagaactgatgccgtattccggtggtttaaagcgtaatattgtacagtgcctgaatgactatgatattcctttgaaattaagccacacggttgtagatatcaaaggaaaagaaagagttgaaggaatcacactggcagaagtggacggtaaaggaaagccgattccgggaacagaagaagaatacacttgtgatacgttattactttcctgcggactgattccggaaaatgagatatccagaggtatgggcgtagatatgaatcctgtgacatccggaccgaaagtcaatgaaagcctggagactaatatcgaaggtgtatttgcatgtggaaatgtactgcatgtacatgacctggtggatttcgtgtcggaagaagcgaagactgcgggaagaaatgcagcagaatatgtgaagaacttacaggcagataccgacaataaggataagcagagcggggaagaagaaacggagattgtattgaatccggtagaaggcgtgcgttatacagttccaagtaccattaatccggttcatatggatgagaatcttacggtgcgcttccgtgtgggcggtgtatacaagaactgttatgtaagtgtatattttgatgaagaacgtgtgatacataagaaacgtccggttgttgcaccgggagagatggagcagattaaacttacgaaagaacagcttatgaagtatccgggtctgaagacaattacagtaaagatagaggaggcgtagaggatgggaacagtaacaacgagagaactgacatgtatcggctgtccgatgggctgccctctgatcgtgacaatggaagccggcgaagtgatcagtgtaacaggaaatacctgcaaacgaggagacgtatatgcaagaaaagaagtgaccaatccgaccagaatcgtaacttctacggtaagagtatccggcggtgatgcggatatggtatcggtgaagacaaaggaagatattccgaaaggaaaaatctttgaatgtgtgaaagcactgaagagtgtggaagttccggcaccggtacatatcggagatgtgctggtagaggatgtggctggtaccggtgtggatattgtggcgacgaaaaatgtagaatctgcataaaatttacagctggcacaaatacatagaaatatacaaaatatgtgaaaatttgctataatgggctcagattaaaaaataaaaatggagagatgatcgtggaaccatattattatagcaagatgaacaaagtacagcaggcagcctatcatgccatccggcagggactgcttgaaatctcagattcaatacagattccaggaatggaggcggaggaactttataatgtattcttccgcctgcgtctggatcatccggaaattttctgggcaaccgggtataagtacaagtattatccggattcgcccaatttcatttttatcccggaatatttatttgataaaaacaaaataaaggaacatcaaaaagcactgaagtccagagtagaaaagctcgtaagcccggtaaaagataaatccgaatgggaaaaggaaaaatatgtacatgatttcatctgtgaaaatgtacactatgataaattaaaaaagtcatattcccatgagatcatcggaccgctcggacagggtgtcggggtctgtgaaggaattgcaaaatcagtgaaagtgctgtgcgatgcactcgggatctggtgtatgatcgcagtctgcggtaacaatccggagaaaggaatcaaataccgtcatacttggaacattgtgagaattggtggaaattattatcatctggatgcgacatttgacaatacactcggaaatgacaaaaaagaaatccgctacgactatttcaacctggatgataaaagcattttcagagatcatgagccgctgatcgctccggcaccaaagtgcgaagaaggggaccatttctattataaagagaagaaactgtcgtttacaaagacagaagatgtatatagaagagcattacagaccgcaaaaaaaggaagagtatttacgtttcactggcggggcggttatctgacgaaagctgttttggaagaacttctggagctgattcagaaagccggaaaagaaaagcagaagaatgcaaggatcagtttgaactggtcgcaggcggtattgcgctttgattatgtagaagatcatggggaagtggaaccggaagttgtggttgaagaggcaaatgaaggagagaaagaatagtggatgcatttgtaatgttgcaagagcttctggaacaggaacagtttgagctgatttttccggagcgatcaatttcagggcaaccggatatccgactggtatatctgatgaatgatgcggtggacagctttcttgtatttcacaatgccagaatgacaggggaatacagaccggactatgaaggagagatatcggcatcgatgagttttgaagatatggagtacattcttgtggtccatcagggagattcagtcgtcacgatatttttcgaagatctgctgacagatgtccatctgtataattatggggagatcggacatttctggatgaaggattatgaatatctgcggcagctggaataccgtctggcaatcatgagagacaagtatgattatctgggagaggaatactgtacaccagaggaacgaaagcttgcgatgctggtggatttcccgccgcttaattactgctgttatcctgcagtgccggaacaatacagcaattgcaaaaggaaggaaaagattctgttattttaagagaagaaccattcgagattgcaaaagacagtatcggttatcagattcatctgatgatctgggagaagggaatcttaaacaggaaagtgaaaatagagagttattcgctggaaaagaataaagaatagcagatgcttgtccgcatgccagtattaaaaatgggcatccacaccggatgcccaaaaggaaaaaagttatgaaaaagaaaaatgatatatataaactcggttgttagcttttattaaataaccgaaggattttttaggcgaagccagatcagataaaagctgcttcatatttctgatacctgagtgacttctttgttgttgatgattatataatacatggcaaatgtttctaatttgtgttataaggctaaagaaaatatgaaaaatcttaagataatctgtaggaaatctaaagtgagcaataagacttccgatagaagaggttgagaaagtgttagcacagtaaaagcccaaaaattatccctgtgtaactgctgctctgctgagtttattcagctttctgatagatcaggcggctatcaccgcttttcaatgtagtatgcccacagcatgtgaagcctaatttggcgagcagatgctgcattgggatattatcatcgtgtgtatcaatcttaatatttggaaactgttcataagcccagttcaggcagaaggtggcaatgcctttcgtgtccggtgctgtggcaactctgtgaacaacggcataagggcaggaattcaaccaggaaccgtcaatgttcagataatcgggatcttcttccggatgaaaatagaatacaccaccaatccgttcccggtcatttgcccggatgatacagacatgtaagcagccggaacggatgtcctgtgtagtcagttctaacggaggatagttgtccttccactggtcagggtttccatgttctttcatatattcccgggcataggcatagattgcaaggatatccgggaggtcattcattgtcgcttttctgatctgcataaaaatctcctttatatataaagcgttcgtttattttcgtaattgtgggaatatctcgatactccgttccagaattcccttcatgtatgcaatcgcagtgccataatttgtgattgggatatctgcatcatcggcacatttcaggcggtatttcatctcacgctcgttcagcatacatccaccacaatggatgatcatcttatatcgggtcagatccagaggaaattcggttccgctggtaaattcaaaggacacgtcttttccggtatattcgcatacccagcgaggcagtttgacagtaccgatatcgtcacactgacgatggtgggtgcagccttcgctgatcagaatggtatctccgtcttccagagtgtctaatgcacgtgcgcctctgacaacggtttccagatttcccttgtatcttgcaaaaaggatagaaaatgaagttaaaaggatatcagaaggtgtatctttgtcaacttctttaaatgcctgactgtcggtgatcacaagcgcaggttttttgcccagtgagtccagagtgctcttaagttccgtctcttttaccacaatggcagttgtaccggcatcgagaagatcacggatcgtctgctgttgcggaagaatcagtcttccctttggtgccgccgagtcgatcggaaccaccagcacgacaaaatccccgggttttacaagatcacgcacaatgaatctggaagaatcctcagaaggaaccagagatccgagccgttccttcagttcatgaatatgaagatgttctgtggtattggtccacagaatattttccagaggaatcttatatttcaggtgtgtggatacgatcatttcctggtgtacatgttcggataccagatcagctttattgagtacgagcaggagaggaatttttttatcctgtatacgtgtaagaattgcattgtcctgtggggtgattccggtggttccatcaactacaagtacagcaatatctgtcttgttcaagacctgataggctttctggatacgaagttttccgagttctcctgtgtcatcgagacctggagtgtcaatcatgacaaccggaccaagcggaagtagttccatggctttgaacaccggatcggtcgtggttccgcgtacatcggatacgattgccagattctgtccggtaagtgcattgatcaggcttgattttccggcattacgcctgccaaagattccgatatgtgtacgttctgaagagggggtgttgtttaaactcatgatgtattcctcgctttctgacagctatgtgtaaagctgaccatataaaaatgttaaaactgtatgaatctgcggtattgtttcaatgattaaatattcagggaatctccacggtctgttacaacctgatatccaacggatttcatccgcatttccagacaatgtctgcactgggcggattcatctccggtacagattttattatcatatagaagataatctttccggacttctgtcggtgagagatttggcattacgacattggctccggcaaggattccgagttcacgtcctttcggatggatggttccaagtgcagttgtggccggaagcagaacctttggaatcatcagacgaatcagaccaagcatatataaggtaagctccagtgttcccgcagcttctccggcaaatggggtatcatggtgtgggatgaacggaccgattccaatcatgtgtggattcagttctttcatgaaaagcatatcttccgccagatattccggtgtctgataaggcgatcccaccatgaatccgcagccgacctgataaccgatgtcctttaagttacgcagacactgctgtctgtgtctgggactaagatttgatggatgaagctgtctgtaatgttcgtgattataagtttcatgacgcagaagataacggtcggcgcctgcatcgaagtaagcctggtaactttcttttgatttttcaccgatggagagggtgatggcgcagtcgggatattgctctttgatcatccggatcagatggatgatacgttcatctgtataatatccgtcttctccaccctgcaagacaaaggtacggaagccaaggtcatatccttctttacaacaattcaggatgtcttcttctgacagacgataccggtgtgcgtttccattgcttttccgtatgccgcagtagagacagtcgtttttacaatagttggtaaattcgatcagtccgcgcacgtagacatcgtgtccgtaatagcggtggcgctctttgcgtgccagggaaaagagatattcggaaagttccggagtgcgtccctcgatcagtgtgatccattcttctttggtaagtgtatgttccttgtgtaatttatcaatgaaacttttttgattttggttatctgtattcatttatagttgtcctttaattgctggttgttgataatcatctccatatagtatatcatactaattaataagagtagacaataaattcattggaaactttggaatgtagtgtggcagcataagtaaaaaggaaaggaaacaaattatgggaattggcaaaagaatattaaatgtactgatcggactgttgtttatcataagtgtaacggtattgggatcaagttttctggcaaaaaaggtattggtggatgcaatcagtcaggcaggagtcgatactgcaatttcacaccggatgatggatgcggtattcggttatgcaggagcggatgatacggaatggatcgcaaagatacagaacaagatcgagaaaaacggagaagtacaggcaattacacaaaaggtcatgaacgagataacagaggatctttccggcggaaaagcgtacaaagacgtagatgtaacaaaagaactgaatcggattctggatgacagtatgcaggaaattaaggatacgaatccggaattaaatgacgatatgctggcaatgatgaaacagcagttgaaagaagaactggttgatgtgcaggatgtgctgaacagctatgcttcaaacttgtatgataatatgaatgataccagtacggtacagggaaaggttgcaaagctttataccatattactgtccataccgtgccgggtggtagcgggagcagcaatcctggttcttgcggttctgacgattctactgggctatccaagatacagaggtctcctttcacttggtgtagaaggtctgatctgcggtattatctttgctccgggaatcggacttatgggaaataaggtactcagcttactgacggacagaatacttggacgtacgattgatgtgaatttgaaggcattcctttggatgggatgtatctctgccggagcaggagtggtattcctgcttgcagggctgatcgtgagctggaaagatgacagataaaaatccaaaattttgaagtatggaattgcctgttataaaaagacatgtaaagctgcattaaagattgaagaataggagctgattcagacatggaaatacaacatatcatccacaatttcgaaccaatctacaatgaacattccaaaatcctgatgctcggaaccatgccgtctccgaaatcccgtgaagtcggattctactacggccatccaagaaacagattctggaaagttgtatcggatgtctgtggagaagcgtatccggagacaagagaagataagattacatttgcattaagaaatggtattgcagtatgggatgtgttggcgggatgtgatatcaaaggagcagatgacagcagtatccgcaatccacagccgaatgatatgagcaggatacttgaatgtgctgatatcaaagcaatctttacgacgggaacgaaagcgttccaattatataagaagttctgttatccgaagactgggattatggcaatcgggttaccatccaccagtccggcaaactgcagaacatcgtatgagcagctccatgaagcatattttgaaatcagaaaatatctggaataaggagtcagatattttctgatatcaaagcaagagaggatatagtataatggacagtctggtgtttagtttaaatgcaacagttcccattttcttaatgatggtattgggactgtttttcaataagattgggtggatggacgaagggtttgccaataagatgaacaaattcgtcttccggataccactgccggtattattattcggcgatctggcggtcgtagatatcaaggaagcgtgggatacgaaattcgtaattttttgttttattattacattgatcagtatcacgatcgcaattggaatctcctgcctgttgaaagacagaagcatccagggagaattcatccagggagcgtacagaagcagtgcggcgcttctaggaattgcatttatccagaatatctatggtaattccggacaggcaccacttatgatcataggaagtgtaccgctttataatattatggcggtggttgtgctgtcatttttcaagccgggacaaaaaggcatgaacaaagcactggttaagaagacactgatcggtatcattacgaatccaatcatcatcggtattgcagcaggtctgttatggtcggcgctgaaacttccgctgcctgtgatcttacataaagcggtcagcagtatcggcggcgtagcaacaccgatgggactgatggcaatgggagcaacctttgatattaagaaagcgtttggcaagatcaaaccgaccgtgatcgccgcatttatcaaattagtgggatttgtagcagtgttcatgccgcttgcggtagtaatcggattcaggagagagaaactgatcgcaatcttagtcatgcttggttcagcaaccacggtcagcagttatgtcatggctaagaatatgggacatgaaggtgtcgtgtcatcaagtgtagttatgctgacgacgatgtgcagtgcatttacgttaacgggatggcttttcatcatgaaatgttttggtctggtgtaactccttaagagtttctgaaaaatccctaaaatccttgacaaatggggattcgatggctatcatattcagtagtttatacgtaaaggcattgatgaagaggagtacacgtaagttcgtccataccagagagagtgatccatcggctgagagacacttaaggaatacgagacgtaggaaggtagcttcggagccggatgagtgaacctgagacatatgataagacggtagtagttcatcccggagtcgttcccgttaaagaataagatgagatatatggggaagagttttcctgtataatgaaggtggtaccgcgactacaatcgccctttacgtaatgtaaagggttttttcagtttgcgcgccatgggcgcgctctaacgggtgtaagtcccgaacacgcccagctcagacctcacggtctgggcgatttttctgtcaggggagtttttttacagcccctttcttttttggggactattcttttttcacagccccctcaatcatttactttataaattttttcttctgcgaagtacgataatcacaaccacaattgctgcaatagaaagaattgcaaataatccaatctgggctgtatctcctgttttcacagtttttactacatccacaaatttttgattatgattttctttcgtattttttgttacttttgtcacgccaagttttttatcatagatccttaaggctgtatcacttgtcttctccgcatccggacctgatataatgctcagaattccatatgcatcaattataaattctgtatcttcagcaagatcatatccttctggtgcagatacctcacgtaaaatatacgatgtatcaacattcaattttcgttcgaatgactcggctgaatctcctgtcgtccactctgctacaatcttaccggaggatttctcaagaatctgcatcttggctcctgtcacaaattcatgatttgtataatccagttttgatacactaagttttgtcacttcatcactgactcccggtgcctcggcaagtactatagcatctttgttatcgtctgcttcaagggcactaatctgtgcatcttccgctgtcagagagtcaagactgaacatcactgcctgtgtacttctactacttctttttgctgtcagttggttaatcgtaccatctgcagataccgtgaatttctttgttgcatattcgtcaacagtatgacctgctggagctgaaacttctttgaagtaataagttcctggttctacattttcaaatgtcatataaccattttcatccgatatctgtgtgcctatcagaatgtcgcggccttcaccactaagtactttatacagtgcataagttgctcccttaagcggatctttactgccgtctttagaagtcttctgtacgcgtatgctgattggattatatatatttacaaatgtcggctcttctgtcggtgcattatcttcaagataagtaatggccgtctcaagatttcctgttgtatcatcctttgttacacttacattgaccttgatttctctgtcatcataagtaatttgtcccggatctgacggaatcaattctttaattgtgtaattataatctccaacttcatcaaatataatggaatcaaagagtacagaaccattgtctgtatttttcttagtatcaatcaagttattattctcatcaaacaactggaatgtaaattctcccggctgaagttcagcattatttaatactttcttaaccgctggatcaatagctgctgctgttacagacatcttattttcaaatgagattccatctacactctcggatgagttatccacatttgttccattttttatgtaagttatagacgtatccatgttttcatccacatttaccgtaacggtatatacagacggatcatattcaatatcgctaacgttattttcaccctgctcattaatctcttttacagtgtaagaataagttcctgctgtataatatggaattgtacggaatgtaatcttaccggaagcatcgtttgtttttgtgtcaatcaatgttccatttgaatcatacagtccaaatcggaattctccggcttccagattaccacctgtcaatgtcttagttcctgtaatcgtggcaagagcataatccatactcattgtcataaagtgatagttattaaatatcaggaattcatcgtcctctactggctcaaatgtattttcatcatcaccttcgtatccatcataaggaacaacgctcttctcgactgttacctgaccgtccttacttactgttacctttgccctgtagacagcctcgtcatagtacatattagcttcctgctgttctggtacattttcagaaatcgtgtagtaataatctccaggtgtatcgtagttgatctctgtaaatgtaatatttccagctgcatcattggaaaccgtctcactgtatgcatcttcgcctgtcaatgcatttgcatatgtatcatctgttcttgtaagggtgaagctaaatgctccggctgttgattccagctcaccatctacatatttctgtcctgtaaatgatgtggatactttgattccgttattgaatacaaccgactcaacattttctgttgttgtctgtccgtctgcaccagttacaagtttcttgtactcagatgctgttgctgttaatgctgctgccgtatcatcctttgtcacgtccacttttacaatataagctgcattgtcgtaaacaatattggcttccggattctccggagctgcttcactgatcttgtagtaatgcgttccggcatctttgtatgtcaattcatcaaaggtaatgagtccactcttatcattacttgctgtaactacttttgttccagctgttacatttccattttcgtcacactcttccatcttgaaatcaaattctttttcagatggacttcctgccagattcttggttgctgtcagctgaatctttgcgtcggaatatgtgattgtctggttattaaatgtaatgtcttttgtatctgataccgtgttgttggcatctgtcttcttagtatctgttactgtagccttaagagaaacttttccgtcttctacagtcttagcaacggttacagttacaagatagcttgatgtatcatacttgattcctgatttcggattattctggttctctgtaatcttgtaataatgcgttccctcgtctgtgtatgtgtaagccgggaatgtaaacttaccagtgttatcattggatactgactgtggtgcttcaccttcaagtgcatcacctgatgcatttgtctcaacgatgtcaaaactatactcaccagctttggacactttctttccatccagtgtcttcataccttctaagcttacagaagcactcatgttatttgcaaatgtaatactgttattctcaacctttgttccagtttttgttttgtagtcgaaatctttgtaatatacagcgtttgtagtaagacctgtaccactttcactgttatcatcttcaaccactacaaccaccgtatatacagtgttgtcgtaagcaattccagtggtatctgcgctgtcatttatttctcttacatcatagtaatgaattccggctttcgtataagaaatggctgggaactggattgctccgttcgcatcgtttttaataaccccgctcttgtaaccatcctctacgattccgccatctgctgatttttcaacaactgtataacggaaaacttctgctgaaggtttatcattcaaagtcttattacctgtaaatgtaatggaaccataacgtacacggtttgtaaatgctgcaacattattattggcaatctctgttccgttgacggttgtaccattcttatctttcagagctgtctgatctgcatattttacaacgtcctgaatctgtgctgtaaatgcatctcctgcctcattattggcaacttttacatgtacaagataaatgctctcatcgtaatccattcccgctattgccggattagatgactgcttttcagaaattctgtagtagtaatctcctgtggcattatactcgtaatccggaaatgtaatgcttccgtctgccttattcttcactgtcttaattgaagcatcttttttaactgttccatttgcatcagcttctgcaatgtcaaatgaaaattcaccatcctgaagtgttaatgctgctccagttgactgattttttccaagaagtgtcttctgtccattgagctgaatacttgtctttttcgtcttattctggaatgtcatatctgctgatgtctggtctgtaatctgacctccattggcattcttgtaatactgaacacttgcagaaagatttaatccattcttttctaccgttacaactgctgtgtagtaagatttatcatatgcgatattctccttgtttccagctttctctgtaaccttgtagtaataagttcccggtgctgtaaatggaatatctttggattcgattgctccatttgcaccattctttacttcttctgtgtatccatttgcaactgctgttccattttcatcgacctggataatgtcaaatgtaaatgcatctttttttgccttatcgttgtcaagcatcttcgttccgtgaagtcggatgcttgtctgcatcttattggcaaagtctaaagtacctttgctttctttattcttggatgtatcagaataattgtaatctttataatactttgtgcttgcaacaagtccgtctgcagtctttgtgacttttacaacagctgtgtatgttgtcttgtcgtaatgaacactgttgcctatctgtgaattctcactgatctcatagtaatgagttccggatttggtgtaatcgatagtcgggaactggattgctccgttttctccctcaccagtcttgttcgtaatgttatcggaaattgtattaactacatttccgtctttatctttttctacaactttgaaagagaatttatcttttgcctcagaaccattgactgtcttattaccagtaaatgttacctgtgcttttaatgtcttatttgcaaatgtaatcttatctgcatttgctgctgattccggattcatctgatcagcacttgcatattttctgtatgtaacagaagctgtcagggaaccatcattctgtgctgctactgacacatgtgcaatatatacactcgggtcatattccatgccatcagcatttgcatttacctctgtaactttatagtaataatcgcctgcggcattgtaagtaaattctggaaattcaattgctgcggtttctgttgtattatttgttacttcccagctctgggcgttatctttcactgttcctttttcatcagctacttcaacgacctgatacttatatgctgctgttgacggctggccattcaaagtcttatttccttgaagggaagcctttacttctcttacaattgatgtatttgaaaatgctgctcctgtatcactattaaccagatttccgtccttatagtaggcaactgttgcagtcatgttctcatctacagtcaccacaactttgtaaacagatgcatcatatctgatattcacatcactgcctgatacttctgaaatcttgtaataatatgttccaggtgtcgtgtaagtaatctcatcaaaactgatctgaccattctcaccattctttacattctgctgatagccattttcaagtactgttccattttcatcagtctgctgaagaaggaatgagaatgcatctttctgggcggaagttccgtttaaagtcttcgtacctttcaaagtaaccttcacagatgttggtttctgttcatttcctggtttccatggattcttatgaatctctccgccaatattttctactgtatctgcaaacacagaaccattatgtgttgttgaaatatatacagttgcgttcggagcaagaattgttccagaatataattctccaaaacttaaagctccttgttgtgtaccaaagttcagaaggattcttcctcctgttacgtcataaccacctgtttcagttccattaattgtaaaatatggttttgtaaattgttgtgccacatcatacttgatattaaatgttacagagccagtatcaccaagaccagtaatctgaacattatctgcccatttttttaaatcacttgctttgatattaataatattattaatattcggtttgcactgaatcgtttggacattatcagatttcgtcgttgtgtttccattaggatttttaaatgtcacaccttttgtatctgattttccgtacattgcacttgcatattgtcttaccccagccattgcagtatcaaaatcaattttgtaggaagagtttttgatattaacaacatctgttacatttccaattttctttgttacaccattaactgtaagtgtaaaattgctatcctgtgttccaggtgtatatgcatctccaataattaatggatttccacttcggaaagcctcatccttgttcaatcctcctacaatattctcaacataactaatatcataatcatgaccatctttaatgtttccagtcattcccattgtatgtgaaccaactgtccaattttgaactgctatgtttccttccatatcattggaatttttataattcttagcaaatactgcaaaatcattaacacttccaagtgatgttgctgttggatttgtaaatgttttgtcgttataagaggactcgtagtaatcggaaatattcagtgtaactgttccgcttgccacatccactgttgcctctgtctttatagagttcttgcagtcagcgccctttgtaaccgtaatcgtaaatgcatttttattaaaaccatttacatcatatgttccacctctgttcttcatcagattgcttgctaagccttctgatggattcaggttagaggctgaaatctttttattattttctgtatttcctgtatcaaatttgatattgaattttgtattattctaatttgtaattccatctgtattaactaccagcttaatactgtcatacccgcttccgctgacgcttccgtctgtattagcagccagtgttggagcaacatctgaagcagttacagttgcagctgcaactgcattttcatttgcctgtgcggtatctgcctgattctgctccgcattgttatctgcggaactggaggcttttgcatctgcctgagtatttttactttcttctgcctgtgtggcatcatcagaagtattctgatcttcttgaacttcttcgacctgagcacttccggtacttttcggttcttctgtattaacagcttcctgtttctggttttcttcactctgagtttctactgccgcctgatcttcctttgcatatagggatgttcctaactgataagatgcatttgctgcgacaagtgcaattgcaagtatcaaggcgagccaacgtcttgtatgtttcatattgtcctacctccccttctcattgcgtttcttagttgccataaagattccaaagatgaccagcagcaatacaattgcaactgcgatggccattccgactttgttttcaagcaatgtttgagctaatggtgttccttcgtctttggatgtctttttgttatcgagtttctgatctgccaacggcacctgatcatctgcactctgtacaacctgagatgtagtgccttctgtgttgccatcaccaagtacggttgtggatgctcctactgtttcaccagttgctgcattcgttgttcctggattttgtgcaactgccacggttgttcccggtaccactctgtagattacatcatctacagtaatctctccaccatctactaccacataagtaatttctgtatctgcattgatagtatcctggctatcacgatagtagatcgtatactgacggatatttgagtagtagctatgacggattgtatcactctgtcctttcagacgaatatatgtatggccgttgttctgatattcagccggacaatcaattactgcatcttcttcatttgtcacagtaattgtctgtgtcgtaatctgcgagcgatctgcgatgttcacatatttgactgtgatatcgtatccattttcaggaatccatttttctttgttataataatagatgttcgtcgttctggatttatcgccgtatgtatgtttgtaagatgactgcatggaagaatccaacgtgtaagttacaccatcgttttcaatggtggatgctacatcataagtttgtgattcatcaactccaatctgttgcgtaacagtcttaagtgtcttaccagtcatcaaatcaatcagattgatgttccagtcataagctgtctgactatctactttttgatatgcaatctttatactcttaccattgtcttctttttttagaactgcctgggctttttcgtcaactgctttataataattcacaatactcttaccattttcatcggtagatgtctggctgaaggttttaggtgcctgataagtatatgttccgtaatatgtaatattttcagaactaagtacatttccagaatcatcggtaagctgaactccggccttataaatattgctgttttttgtggaatcatgtttcacatagtcaacactgtaaccggaactggatttattatcgtcgtaaccgacagaaacatttccatttccattcaaatcataatcaacatcgttcactacgcaagattcacttgcctcatatgttctgcttttttcagcttcgcttacaactccatttgccatcggcacgtttgtacttgtatcacctgttagatttgcctgcacttgataaagttttgcagaagctttaatattcttgtcgaccccatatacctctactgtatatacagaatttccgtcataattctccaggtcaagtacaagagtatctcctttgaatgcctgcttcttagtgatttctttattatcttcttttaaatcataaaacagaatatcttttcctgtctcattatcaatctgcatactccagtgattctgctggtttttagcatccgaagaccctttcaatatctccgttgtatttcctgtaatggttattgatttcgctgcatcctgtgcataaaccatgtaaggatttacggttgctacgcctgtaaatgtcaaaattgcggctgtgattgcagctattcgttttccacgtcctgcatttcctttcatcttattcattcccttctcttttattttgtacacgtaaagtttgaatatagttccattttacgaaacataaatactattattttcttcttcacttatattaagactttttcataattttctttttccctggccaaagcccagttataagcaaatcttgaagcacctgcgtactgaaacatcttagttttctgtatccggattgtccggtcttccagctgcttttgcaggtcttcgatcgtcttcttctgttcttctatctcttttttcagatggtagatgatatcgatcagctgacttctcttcagtcttcggaattctttgtctgtcatccggctctctcctggttctcttcttctgcgtcttcctttatgtccatgccacccagtgcgccatcgatcatcttgagcagttccagtgccgagcggaagttctctgtctttccttcttccacccatgtaactcttccctgccagctgctatgttgtctttgttctactctgattatgaatgttcctttttcaccattattctttaacatctcttcatcactcaactttcttgccatttttatccgctgtgttttttcatgctttataaaatagtggctctctgttccgggaaacggatatcccaaccggtcaaaaaaagcatcgatttcgaaaactgcttccagcatggctccttctttcatcggtcttcctttgctgtccacaatggtacacagcataagatagatcgactgtccgctccgttccagcatcctcaccagatgatgatagattccgcggaatgtcggataactgcacagatatgccctctgcgggactcctttttcttccagattgtgctggatgttgtccagtacgtcgtaggaatgcatcacctggttaccaagctggttcatggaatccagaagacgtttggacggttttaatccccgttcttcaaaatatcgttctgccgtatcggcatacagatcagtggcttcttcgtatcttcccagtgcaaccattgcttccatggtcaatgcttcccaatcggagaatggttcgatattcgatgcatatactccgagatgttcgagctgtgtatagttctgcttttcccggtacagtctggctgcttcttctacatattcccggaacatgtcctcataccgtcttgcttcaatggcaacccagatcacactctgccgtttcacaaggaattctccggtatagatctcgaatattttttcgaggtcttttatctttttatccggatttttctcatgttttattctgttgtatatctggtcaaattcggttgcatcttcctgtactttgatctcgtcattccagtagacgacaccgtttctgatctctatatagtttacatccggaagtcctgctttttccagtctcttctttgcgttgtaaatgacgctctgaagggcatgatgtacattttccacttcccgttccccgaacagttcctgttccagacggtccctgctgacaccttttttccgttcatgtatcagcatctgcatcatagaagcgaactgtgtctctcctacttttcttccgaacagggattttccgtcatatatcatggaaaaactgccgaatgtcttaacctgtaatattttttctctcatttccctgtaatccttttatacattttcattgatcgtatgctggattctctctcttacaattgctgcaatttctgttgtcttcatgtctttgtattcttcgtaaagcagcggctctaagaaatgtacctgtacattgacatgttctgttgtcttagagtcgaacggcacgaaacagttgatcagtgctaccggaataatcggacatcttgccctggtcgctgctttgaagctgccgcctttgaagtcttgtacctgattgccctgtctggatcttgttccttccgggaagatcagaaagtttcttccgttcttcacgtcattgctgacatttacaatcacctgcagtgactgacgcacgtcttcacggtcgatcatgtatgccttcatgcaggtgaatacctgcttaagaaatggtacgtcggccacttctttttttgcgactaccgcgaacgggcgcgggcatgcttccattatggcgagcacgtcgtagagaccctggtgattcgggtagaacatgaatccgtcctgttcggggatgttctcctgcccgtgtacctcgatatggatattcccggatgtatttgcccggtgatcgatgtattttaataatttatagtgttcttcttccgtatatttgtctacgtgtctggcatggtagcataacttgtaccagtagaccggcacgaagaaaatattccggagtaccatcagaaggattcttctcatatctttgcatactccttgatcgcagtttcgtacaggttattgccttcgctgtcgatgactacgatgagcggaaggttctcgacctgtaatttacggatggcttcggttccgaggtcttcgtacgcaatgacttctgaggatttgatgcatttggataacagtgcaccggctcctccgatggctgcaaggtatacgcatccgttacgtaccaccgcatcgatcactgcctggcttctcttgccttttccgatcatggccgtctgaccaagatccagcagacgtggtgcatacttgtccatacggctggcggttgtcggaccggctgatccgatcgggcgtccttctcttgccggagatggtcccatgtagtagattgcctggtctttgatatcgatcggaagtgattccccgcggtccagtgcttcatccatgcgcttgtgtgccgcatctcttgctgtgtagatggttcctgtgacatatacataatctcctgcgtgaagagatctggctgtttcttttgtaattggtgctgtgatatgcttgtccatacttacacctccctgatgatatgacggttcacatggcagcagatgttgactgcaaccggcagtcctgcgatgtgtgtcgggtatgtattgacattcactgcaagagctgtggtcgttcctccgagtccgcccggtccgattccaagcttgttgatcgtctcaagcatctcttcttccaggtcttttacccaggcagttccggaatgggatccggcttctcttgtaagggcttcttttgccatcagtgcacatttttcaaatgttccgccgattcctacgccgactaccatcggcggacaggcattcggtcctgcgtctctgactgctgtaaggatcgcttcttttactccttcgatcccgtcggctggttttaacatgaatacgcggctcatattctcgctgccgaatccttttggcgcaacctttatctctactttatctcccggcacaatactgtagtggatcactgccggtgtgttgtctttggtattctcgcggatgatcggatctcctacgacggattttcttaagaatccttctacgtatccctgacggacaccttcgttgatggcatcttccagactgcctccttcgaagtgtacgtcctgaccgattttcatgaagatgacggccatacctgtatcctggcagatcgggatcatgtcttctgcagcgatcttcagattatcctgcagctgatccagaatctgacggcccagtggtgcttcttctgtctccagtgcgtgtttcattgctttgtccatgtcatcggcaaggaaatgattcgcctgtatgcacatgtcttttatattttctgtgattgtatttacattgattgttctcatctatatcctcctggggacatgggattttttggaaccttctgttcctgctcaaaaaaacctgtccttttttattttaccctgttccaagatgatatacaagtttttttcgccgtggtataatggatttaacacatttttcaggagggattataatgacaacaaatgtagatttagagaaacttcaaaaggatgccgtggacatctttaatcagggttttgcctgttcagaatctgtcatttatgcaatcaaagagaattttgaactggacatgtcggatgatgcgattgctatgagttccggattcccatgggggcttggcggaggcggatgtatctgtggtgcactcgccggagcaacgatgtgtatcggatatttcttcggacgtaagacacctggtgatcctaagattaaccgctgtttcaagctttcgaacgaaatccacgatttcttcaaggaatactgtggtgcaacatgctgccgtgttctgacaaaaggcaaagagaagaattctccggaacgtaaagcacagtgtacagactttgtagctgctactgtgaagaagactgcggagatcattcttcgtgaacttgctgcagatgaggcggaaaaataaaaatattttttcaaaaaacgaggcggaaattttttaatcttccgcctcgttttatgtctttattcttctgtctctacgttctctgcatcttctgtactttcttccggctctaccagatcatcttcggattcatcgcctctacgtacttttgcaatacaagctactttatcgccttccggcaggttgataagcttcactccggatgtcactcttccgagttctgaaattccgtcacacttcatacggatgatgattccctccgtgttgatgatcatgatctcattgtcctcgtctacggctttcacacctacaacgttaccggtcttctctgtgattttgtagcacttcacacctttaccgccgcggttctggactgtgaattcatcgatggaagtacgtttgcccattccgtattctgacacgatcagcaggtctgttccctgtgaatcgatctgcattccaatcacttcatcacggtctaccaggttcataccacggacacccatggatgttcttcctgtcggacgtacatcactttcattgaagcggatacactgtccatactttgtaatcatgaatacatcatgatcgctgtctgtatattttacctcgatcagctcatcttcctcacggagtgtgattgctgcaagccctgtctttctgacatttgcatattctttgatcggggtcttcttgatgagacctttcttggtagccatcagcagatattcgtcatcgttatatttctcgatcggaatgaccgcactgatcttctcgcccggcattaactgtaacagattcacgatcgcagttcctctggatgttctgcttgcttccgggatctcgtatgctttcatgcggtatacacgtccggtgttcgtaaagaacatcaggtagtgatgtgtattggtcatgaagagttcttctacataatcctcgtccagcttctgcatacctttgattcccttgcctccacggttctgggctttgaatgtatcgtgagacattctcttgatatatccaagttttgtcatcgtgatgacaacatcttctcttgggatcaggtcttccatggagatatcgaactcatcgaatccgatggatgttcttctctcatctccgtatttatcacggatcacaaggatctcttctttgatcacgccaagtaataactttctatctgcgaggatcgcacgtaaatgttcgatctgctccatcagtgctttatattctgcttcgagtttttctctttccagacctgtcagggcacgcagtctcatgtctacgattgcctgcgcctgtacatctgtcagtccgaaacgctccatcaattctgattttgcgatctggacagtctgtgaacctctgatgatcttgatcacttcatcgatgttatctaatgcgatcagtaatccctgtaagatatgcgcacgttcttcggctttatttaactcatactgtgtacggcgtgtcacaacttcttcctgatgtctcagatagtagttgagcatctccatcaggttcatgaccttcggctcgttgccgaccagtgccagcatgatcacaccgaatgtgtcctgaagctgtgtatgtttgtataactggttcaggataacatttgcattagcatctctcctgagttcaatgactacgcgcattccttcacggcttgactggtcacttaagtctgtgatgccgtcgatcttcttatcacgtaccagttctgcgatcttctcgatcagtcttgctttattcaccatgtaaggaagctcacttacgatgatgcggctcttgccgttcggcatcgcctcgatatctgtcaccgcacgcacacggatcttgccgcgtccggttctgtatgcctcttcaattcctctggttccaaggatcatacctccggtcgggaagtccggtcctttgataatctttaagatctcttcgatcgttgtctcttctttatcctcgatctggtcatcgataatctgtacaaccgcattgatcacttcacgcaggttgtgcggcgggatattggttgccatacctacagcgataccggaagtaccgttgaccagaaggttcgggaatcttgccggcagaacggtaggttctttctccgtctcgtcaaagttcggaataaaatcaacggtatttttattaatatccgccgttaattccatggaaatcttactcagtcttgcctctgtgtatcgcatggcggcagcaccgtcaccgtccacagaaccaaagttaccatgtccgtctaccagcggatatctggtagaccattcctgtgccatattaaccaatgcgccatagatcgaactgtcaccgtgcgggtgatatttacccatcgtatcaccgacgatacgtgcacactttctgtgcggcttgtcgggaccgttattcagttcgatcatagagtacagaattcttctctgtaccggtttcaaaccatctcttacatccggcagtgcacgggacgcaataacactcatcgcgtagtcgatataagaggtttccattgtctgtttcagatccacttcgtggactttgtcaaatatattgtcttccatcaatctctcagagatgtaagtatctctgttcctcctttcttctacacgctgttattatacatccaggttcttgacatattttgcattttcaacgatgaactcacgtctcggttcaactttgtcacccatcagggtggtgaatgtaaggtccagttcactcgttgtctcatcgtccatcgttacacgtaagaggatacggtgctgtggatccatggtggtatcccatagctgctcggcatccatctctcccagacctttgtaacgctggatcttattattcccgtcacgtccgacttcttcgatgatcttgcttaattcttcgtcactgtatgcataccataccttcttgttcttctcaagcttgtagagcggcggttgtgccagatatacatatccctgcttgatcaattccggcatgaaacggtaaatgaatgtcagaagcagtgtactgatatgtgcaccgtccacgtcggcatcggtcatgatgatgatcttatgataacgcagcttggaaatatcaaaatcctcatggattcctgtaccaaatgctgtgatcatcgccttgatctcggcattgccgtagatcttatccagtcttgccttctctacattcaggatcttaccacgaagcggaaggattgcctgtgtcgcacggtcacgtgcagtcttcgcagaaccaccggcggaatctccctctacgatgtagatttcacaattctccggattcttgtcagaacagtctgcaagctttcccggaagtgccatgttatcaagtgctgattttctacgtgtcaggtctcttgcctttcttgcggcttctctcgcccgctgggacatcacagatttctccacaatgatcttaccaacggccggattctgctcaaggaagatctcgagctgcctgctgaccacattatcaaccgcacctcgcgcctcactgttaccaagtttctgcttggtctgtccctcgaactgcgggtcttcgatcttgacactgatgatcgctgtaagaccttcacggatatcttcaccgcttaagttcggctcattttcacgcagaagcttattctttcttgcatagtcattaaatgtctttgtgatcgcattacggaatccgacaacgtgtgttccgccttccggagtcgtaatgttattgacaaatccatacgtattatcgctgtaagaatcgttgtgctgcatagccacttccacagacacattattgaccatgccttcacagtaaatgatctgctcataaagtggtgtcgcactccgattcaggtaagaaacgaattctttgatcccgccctcgtagtggaatgttctttcttttggttcttcctcacggtcatccctgagcacgatcttcagaccttttgtcaggaaggccatctcacggaatctctgtttcaggacattaaaatcaaagatcgttgtctcgaaaatggtatcatccggcaggaatgtgacttttgtacctgattttccttcttcacattctccgatcactgccagtttttccataacttttccgcgttcataacgctgctggtagatctttccatcatggaagatctctacttccagccagttggagagcgcatttacaacagatgctccaacaccgtgaagtcctccggataccttgtatcctccaccgccgaactttcctcccgcatgcagtacggtaaatacgacttctaccgcaggaagccctgctttgtggttgataccaaccggaattccacgtccattatcgataacggtcaccgaattgtctttattgattgttacataaatcgtatcacagaatcctgccagagcttcatctacggcattatcgacaatctcgtatacaaggtgatgcaaacctctggaagatgtacttccaatgtacataccaggacgtttgcggactgcctcaagaccttccaatatctgaatttcatctgcgccgtattcatgctgtactttttctgtacccattctcagtcctcctagttttctttcgttacctgtccgttttggacatggaacactttgtttattgaaaagcggtgatttacaaaatcctcaactcctgtacaggtgatcagggtctgtatatcatgtatgctgtctaacagatagttttgcctgtgtttatcaagttcagacaatacatcgtcaagtaaaagtatcggtgtgtcatgcgttgccagcctgaccagctcaatctccgataacttcaaagacagggcagccgttctctgctgtccctgggagccatatctgcggatatccatatcgccggtcagaaatccgatatcatctctgtgtggtcccaccgttgtgctcttcattctgagatctctgtcacgataccgtttcagtgcctgttcaaacggcagatcccccgtacttggctcatatatgatctgcaggctttctttgccgccggtcagcttctgatggatcttcgcaatgatctcattgatctgtgcgacaaattctttccttctggcgatcagcctctccccatattgtaccatctgtatctcccatatttccagtgtatctgaaagttctttcttaccgccgaaacttaactctttcagcagacggtttcgctggttcacgatacggttatagttcgacaggttattcaggtacaccttatcgagctgcgaaagttccagatcgataaatctacgtctctctgcaggtccgttcttgatgatattgaggtcttccggcgagaagaatacaagattcacgatcccgaaaagttcacttgctttccggatcggcatcttgtttatcgcaatccctttcgggctgttcttcttcaggtgcatgtcgatctgataactgataccattcttctccaccacagtctcaatgtgggattcatcctcaccgaaccgtatcatgtccctgtctttcgacccgcggtgggatttggtcgttccggacagatacaccgcctccagaatattcgtcttcccctgcgcattgttcccgtaaaaaatattcgtagaaccgtcaaactccacattcagaagatcataatttctaaaattttttaatttcagggaattaaccttcaattctgatctcttctccgtcaaataatacgatatcgccgccatataacttacgtccgcggcgtgtatctgtctcgccatttaccatgaccagaccttcctgtatcacttcttttgcttctactccggattccaccattcccgcagcttttaaagcctgtccaagcttgatatattcacctcgtaatataattgtctccatacgtcttgtatcctctcctggatatgcatttctttgtatttttatgcatatttttcttcttttagccgttgttttattatactcattgctatatacttttgcaagcattcctgcattttatcttgttttttatttcgttcccgaaaaggctctcttcaggtcttcccggacagtcctatgctgcggagttaaagttgaccggaaggatcaggtagacataactttccgcatcatccttgataaagcaaggtgcttttgcattcatcagatagatcgtcacttcctcatcatcgataacacggagtgcatcgatcagaaatttcggattgaatccgatcagcagatcttttccttctttcgtgatcatgatctcttcattcatagatccgatctgggatttgatttttaattccatcagttcatcgccgatgttgatgatgatcggttttttatcgccttcttttaccagaagtgttgcacgatcgatacagctgagcagttcttttttgttgattcttacttttgtctcgtaatcactggataacatctgatcgattctaaagtattcaccttcgatcaggcgggataccacgatggtattatcaaattcgaacacgatatggttctttgtatatgaaatcgataccacattctcagcttctcccgaaaggatcttactgatctcgatcagggtttttcccggtacaaccagttttctgtccgcaacacttttcttcagcggaaccttacggatggaaattctgtgtccgtcaagcgaaacaactttcagaatattgtcactgatatcaaacaattcaccggtcataagcttgttgctctcgctgtcagagattgagaaaatagtctgacgaatgacttcttttaatgtgaattgagagatttcgatagaatcttctttttcgataatcggtaagtaggcaaattcatcaccaggtttgccggcaatatcaaactttgctttttcacaggtgatcacggtctgaagattatctaacgtttcgatcgttacttcattatccggaagttttcgaacgatttctgaaaaaatcttcgcatcgattgcgatcataccacgatcaatgatgtctccagagatctctgtcatgataccaagttccatatcattagctgttaatttgataatatctgttgttgcatcgattaagatacattcaaggattggcattgttgttttagaaggaactgctttggaaacaatactgacacctttgaccagattcgatttactgcaggtaattttcatgtgtgtataactcctttcgcacgtgtgtaatggataaataaataaaatagtttccgccttagccgtcttaggggatgtggaaaagaggaaaagtgcctctagcccactgtttgcaaggaaaatcggctttgaaaactctgtggaatctgactggattatgtgtggaactgttgttgaaaactttttcgtttctaaagacagttgcagaaatcctgtggttttcccaaggctatcccatagttatccacatatgataattagattttccacatagttattcacagctgaaaacagcaaaataaggctaagccgggttgatcttcttctttatgatattaatagtgttagaaagagtctcgtccgcctgtaattcgttctcgattttttcgattccatgtttgatggtagaatgatcttttcccccaaggatgacaccgactgcttttaatgaagtttctgtcatattacggatcagatacatggcaatctggcgcggaaagacgatctcggcgttacgtttgccgcctttgaggtcggcaatagacacaccaaaatgatcggaaacgatatccaggatcagttccggtgtaacttctctcttattatccgaagaaatgatgtcttttaatgcttctgctgcgagcgcaatatcgatggattcgttattgttcagcttataaagtgcgatcagcttattaagagagccttcaagttctcggatatttgtcttaacgttcgttgcgatatactcgagtacatcattcggaatgttatatttttccaaatgatccagttcgatcttcttctgaagaatcgccatacgggtttcatagttaggtgatgaaatatcagcgatcagaccccactcaaagcgcgtacgaagtctggcctccaaagtctcaatatctttcggcggcttatcagacgatatgatgatctgctttccggaagtatgcagatggttaaatgtatggaagaactcttcctgtgtactttcttttcctataatgaactggatatcatcaatcaaaagtacatcattattacggtatttatcgcggaatttcgacattgcggactcgtttccggcggttttaccgttcttcagagcttcgatcagctcatttgtaaatgtctcactggttacatagagtacttttttctttggattcttgtccagaataaaatgcgcgatcgagtgcatcaaatgggtctttccaagtccaacacctccatataagaagagaggattgtatacttctcccggagattcggcaacagcaagggaagctgcgtgggcgaaattattattcccgccgacaacgaaggtatcaaatgtatacttcggattcagcccggctttctccgcagcacttttgctttttttcttctgattcgcttcaatggccatattctggatctcattcagtctgtcatcatcttccgaaatgaagacaacgtcatattcagttccggtagtctccgcaatgcatacctttaatggaagctgatattttttctctatatattctacactcgcattcatatttaccaatataaatacggtattgtctacaacatcgtagaccttcaacggttgtatccatgtattgaatgatacattggataactcgtgttctaccctgagatgttcgataatttcaggccatttttccttcactgtattcatcatatttactcctaatctgtctgattcgcggattttcacctataaacccactcttctacattgtacatcaaaaagttgctttaggcaatctttaatcgtgcactttgatgcatgtgagaaactgtggaaaactcaatcccaattatcaacatagtaaaaatgcgtatgtaaaggggaaaaaaactaaaaaaatatatgatttccacacgttatccacagaaatccacaaagttttccacaaaatgtggataaatatattttaaaaatttgcggaattgcttgacgtagagcggtttttttaatataatcaaggctgatgtcttatgaaaattagggagaacatcccttggaataaaataaggaggtggatatccatgaagatgacattccagccaaaaaagagacagagagctaaagtacatggcttcagatctagaatgagcacagcaggtggaagaaaagtacttgctgcaagaagagcaaaaggaagaaagaaattatcagcgtaggccgcatatatgtggccttttcttctactcagaataattaggagaatcacacaatgaagtattccgaatcactgaaaaagaacaaagatttccaatatatatatagaaaaggaacatcttatgccaacaaatatctggttatgtatgtactggagaatgggactggtcagaatcgattaggaatatctgtaagtaaaaaagtaggaaacagtatagtacggcacagattaacgaggttaatccgcgaaagctatagattacaagaagaacggttcagatgtggattggatattattgttatagcaagaataggcgccaaaggaaaaggttataaagagattgtcggcgcaatgctccatctggcccatcttcataagattatagatgaggggtaacgtattatgaagaagattctgctcactggtatcagattttatcagagatatctgtctccgataaagggcggttccacctgtaagttttatccgacctgttctcagtatgcgaaagaagcaattgagaaatacggcgcgttaaaagggggacggctggcagtgtggagaattctgcgctgtaatccgtttaccagaggagggtacgaccctgttccttaaaaagattacaactacatatggaggaaaaaattatggtaccaagtttactgactgccgctaactggccgatcgtcggacagctttgctggattctgggtaaggtaatgaactttatctataatttactggacaactgtctgccaagcgataatggactggtaggtctgtcaatcattctgtatacgatttttgtgtatacgttattacttccacttacagtacagcagcagagaacatcgaagatgtcatctgttatgaatccggagattcaggctatacagaagaagtataagaataaaaaagaccaggcatcaatgatgaaacagcaggaagagattcagcaggtgtatgacaaatatggtacatcgatgtcagcaggatgccttccgttactgattcagatgccgctgttgtttgctttgtacccggttatctataatatccagaaatatgttccggagatcaagacagctccaaaagcagtaaatgtattcctgacccttcctgacctgaccatctcacctatgcagatgatcaagaacagcggggactatggatttgcaccggttgttattattattactgcaatcttgcttccggtattatctggtctgacacagtacggaagtatcaagctttcacaggctatttccggacagcagcttgataaagataacccgatggcatctacgatgaacacgatgaatgtgacaatgccgctgttctcggtatttatggtattttcacttccgacaggtatcggtctgtactggatcgtcagtgcggtagtacgttgcgttcagcagatatttatcaataagcatttaagcaagatgtctgtagatgaaatcctggagaaaaacaaggaaaaggctgaggaaaaacgtgtaaaacgtggcgagaaaaatgaacgaatcgcagcaatggctcagacgaataccaagaatatgaacaaccaggcatccatgaaaaagcagagtacatctaacttaagtgaaaaagaaagagaagccagagtgaaaaaagcgcaccagaaagcagacaatgcgaagaaaggaagtctcgcatcaaaggcaaatatggtgaagaaatttaacgaaaatgattagggggcggctgtaatggaggattacattaccttatcagcaaagacactggacgatgcgattacagaggcactggttcagttaggcgtaacaagtgatcgtttagattatattgttgttgaaaaaggaagcgaaggtttccttggaatcggaagaaagcaggctgtgatcaaggcccgcagaaaacaggaagaaaaaccggttgaagaagttgtaaaagaagagccgaaagtggaagaaccggtaaaagaatattcacacgccagaaaaccggcgagagaagagaagccggaagtaaaatctgctccaaagaaagaagcagaacttgcaaaggtggaaccacagacgatcgagacatgtgaaaaattcatctatgatgtgatgaatgcaatgggcatggaggatgtaaaagttacatctgctgtagatgaagaaggtgcactttctatcaatatggaaggaagcaatatgggtattctgatcggaaaacgaggacagacacttgattctctgcagtatcttacaaatcgtgttgccaataagatgcaggatggatatgtaagagtgaaacttgacacagaggattacagaagaagaagaaaagaaacactggaaaatcttgcaaagaatatcgcaagtaaagttaagagaacaagaaagacagtttctcttgagccgatgaatccatacgagagaagaatcattcactctgcgctgcagtctgacccggcagtatccacacacagtgaaggtgaagagccttacagaagagttgtggtaacactggtaagaaacagaaataaccgataattaagagacaggggtctttaagcggcccttgtcttttttgataccaaagtatggaggaaatatggaacaattatataattccacaattgccgcaatatctacggcaatgagtaattccgggatcggaattgtacgaatgagtggtccggaagcatttcagatcgcagaccgggtgtataaagggaaaaaagagaagaagttatgtgaacagcaatcacatacgatccattatgggtatatggttgatggagatcaggtgatcgacgaagtactggtcatgctgatgcgcgggccgcacagctacaccggtgaagatacggtggagatcaattgtcacggcggagtctatgtggtaaagcgtattctggagcttctgatcaaaaatggtgcgcgcccggcagagccgggagagtacaccaagcgtgcgtttctaaatggcagactggatctttcacaagcagaggctgtcggggacctgatcgcatcgcagaacgaatatgctttacagagttcagtgagccagcttaagggcaatatcaaagataagatcggtgaaatgcgtgaaaagatcctgtatcacactgcatttatcgagaccgcactggatgatccggagcatatcagcgttgatggatacggggaaacactaaaaaaagtggttgatgagatcatagaagcaatgaaaagattgctagatagctgtgatgatggtaggattataaaagagggcgtacgcacagtcatcctcggaaaaccgaatgcggggaaatcatccctgttaaatgtacttctcggtgaagaccgggcaatcgttacagatattgcaggtacaaccagagatgtattggaagaacacctgaatctgaagggaatttctttaaatatcatggatactgccggcatccgtgatacggaagatgtggtagaaaagatcggtgttgaccgtgcaaaagaatatgcagacaaggcagacctgatcctgtatgtgatcgatgcatccagaccgctggatgaaaatgatgcagagatcctgcatctgatcaaaggaaaacgtgcgatcattctgctgaacaaatccgatctggatatgcaggtgaaaaaagatcaggaagagctgccggaggaattcccggtgatcgagatctccgcaaagaatgtggaggggatcggagaactggaagatacgttaaaggagatgttcttccagggcgaactgacatttaatgatgaaatctatattacgaatgtgagacagaaaacagcacttcaggatgcatatgccgcacttgaacgtgtgaatgacagcattgccgcagatatgccggaggatttctattcgatcgatcttatggatgcatatgaagctctcggcaatatcaccggcgaaacgataggagaagatttggttaatgagatattcagcaaattctgtatgggaaaataaagataaatatgatgttgtcgtcatcggtgccggacacgcaggatgcgaggcggcactggcaacggcgagacttggatttcagacactggtatttaccgtaagtgtggacagcattgcgatgatgccgtgtaatccgaatatcggaggaagttccaaaggccatctggtaagagaactggatgcccttggcggagagatgggaaaggtcatcgaccgtacatttatccagtcaaaaatgttaaataagtccaaaggcccggcggtacattcgcttcgtgcacaggctgataaggcggtctatagcagaacgatgcgccgtgtactggaagcgcaggagaatcttgagatcaagcagggagaggtggcaaatctcctggtggaagatggaaagattaccggagtgcagacattttcgggtgcaacttatcactgtaaggcggttatcatctgcagcggaacttatctgaaggcacgttgtatctatggggatgtgagtcagtataccggtccgaacggactgcaggcggccaatcatctgaccgattgtctgaaagaactgggaattaagatgtaccgtttcaagacaggaacacctgccagggtagaccgtaaaaccgtggatttcagcaagatggaagagcagttcggagacgagagggtagtgccgttttcatttactacgaatccggacgatgtgcagatcgatcaggcttcatgctggctgacttatacaaatgagacgacacatgatatcatccgtgccaatctggacagatcaccgctgtattccggaatgatcgagggaacgggaccgagatactgtccgtcgatcgaagataaagttgtaaaatttgcagataaaaagcgtcatcaggtatttcttgagccggaagggctggagacggatgagatgtatatcggtggtatgtcgagttcgctgccggaagatgtacagtatgccatgtaccgcagtgttccggggctggagcatgtgaagatcgtaagaaatgcatatgcgatcgagtatgactgtattgatgcaagacagttaaaaccatccctggaattccgtaacatcagtggattattcagcgcgggacagttcaacggaagctccggctatgaggaagctgccgcacaagggcttatagcgggcataaatgcagccagaaagctgcaaggcagggaatccctggtgttagaccgttcagaggcttatatcggcgttctgattgatgatctggttacaaaggaaagtcatgagccataccgtatgatgacttccagggcagagtaccgtctgcttctgagacaggacaatgcggatcagcgtctgacggaaaaaggctatgaagtcggtctgatctcacaggagcgttacgatcgcctgaaggaaaaagaaaggctgatagagtcggaaatcgagcggttaaagaatgcttatgtcggaaccagtgaaaagatacaggaactcctggaatcctatgaaagtacaccgctgaattccggaagcagtctggcagaattgatccggagaccggaattgtcttacgaagcagttgcagatattgatgtgacccggccaaaattgccggaagatctggcggaagaagtgatcgggcaggtggatatttccctgaaatatgacggttatatccagcgtcagaaacgccaggtagagcagttcaagaagatggaaaataagaaaattccggaagatatggattatgatgcagtgaacagccttcgtatcgaagcggttcagaagctgaaagagtacagaccggtgtcgatcggacaggcgtcacgcatttccggtgtgtctccggctgatatctcggtgctgcttgtatatctgagtggaaatcacagataaagtgcagagatacaacggattacagtggtaaatatatttataattatatcataaaataatataaatataattatatagtaaatgtaataataagtatataaaatgaataacatgaaaaatcatacattttatatacttattgattttagagagaaataaggagaaaaatatggaccagattttgaaaaaaagcctggaaaagataggaatagagatcacggaccggcagaaagagcagtttgatgcctatcataagcttcttgaagagtggaataaggtgatgaacctgaccggaatcacagaatatgaggaggttgtggaaaaacattatgtagacagcctttctattgtaaaagtcatggatatggctaaggtagatcaggtgatcgatattggtacgggggcgggattcccgggattaccgcttaagattgtatttccgcatctgaaagtgacattgcttgattcgttgaacaaaagaattaagtttctgaatgctgtaatcgaagaactgggattggaagatatccacacaattcatggaagagcggaagattatgccaaagatgcagcatatagagaacagtatgatctgtgtgtgtccagagcagttgcaaatctggcaacgttgagcgaatattgcctgccttacgtaaaagtggatggtatgtttgtaccttataaatcgggtgagattgatgaagaagtaaaagagtcgtcgaaagcggtaaagatacttggtggtaagattgaagacgtagtaaaattcgagcttccgggaacagacatcggcagatcgttcgtgaagatccacaaagtgaagaatacggcaaagaaatatccacgaaaggctggaatgccttccaaagagccgatacggtaagaaaaatagcaatttgataagaattttgtgaaaacaagaaaatgtaaaaggggcaatgtttcatgtgaaacattaccccttttgtaaaacttaatattatttactggtgatacaggcagaacactagcagttgtcgcttagtaatatgtctatctgctctaaaaatgcatcagcattttcccgctgcggcagtaatccacagcctgcaatttcaatatgctcaatggatgggagaacattatagtattcttcagctttttcgaaagtttccggtgcatttttcccggaaatcacggcaatggaagttgtaagtccttcgagacaatgagcaatatttactgttgtataatgacctaaaatgctggagtagagatatctgcattcagcagaatccgaaagtgcagtgttacgtgcgccaacattatagatgaatgttccgtatataggcagatttataatacttgcgagcaactttgacttgtggtttggtgctttcgcaagtgtgcggatgctttccggacaaacaaggactatatgaccaatctgatcggtgatgttctgacaggcagctgttacaaaagaaacagatgctccggtcgcaacgatatctgtcttttctccaatgatatcacggatgaaatcagtgagaagctggacatagagatagcaggtgtatgtgatggcaggtttatcagattttccacatccaagaagatctatggtatacacagtgtgttctctggaaagagtatcgattactttgtcccattccattgaagaactgtaatgattcagatcatggatgagaagaagaggagagccgcttcctgtcttttgataatatatatttccaaatttccaattgtagtagttggatgagtcttcttctgagtgttcatcagaggtgttgaatatgaatttgtttattacgtggaacgccagggttgttgttccgattgctgtcgagatgaacaataatgtctttttccagttcatgttgatacctcactttcttactactaattatactatatttacttataaattggaagattgcctttgcaaaatgaacgcaaaatgaacatctgtgtaatcaaagaaaatgtttcacgtgaaacattaaaaaataaaaagaataaaaagaatggaaaagcataaagataacgaaaataacaaatagaacagattcatatttatgaaaaatggaaaaactatgtttcacgtgaaacattttatggataagtacctggaaaagtgatatactaatatcatgtaaaaaaagggaaggtgataattaaatgggacgagttatagccgttgcgaaccaaaaaggtggtgttggaaagacaacgacagctattaatctgtcggcatgccttgctgaaaaaggccagaaagttcttgctatcgatatggatccgcagggaaatatgacgagtggattaggaatagacaaagatgaagttgaaaagaatatctatgatcttatgattggacaggttggtgtagaggaagtgcttcaaaaagaagcaattgaaaacctagatattattccgacaagtattgatctgtcagcggcagagattgaattgatcggtgtggatgataaagaatttatcatcagaaacgctattgcaccaatcaaagacaattatgattatattattattgattgtccaccatcgttgagtatgctgacaattaatgctatgacaacagctgattcggtgctggtaccgattcagtgtgagtactatgcgctggagggattgagccagttaatacatacagttgaactggtgaaagaaagattgaatccaattctgaaaatagaaggcgttgtatttacaatgtacgatgcgcgaacgaatctttcacttcaggttgtagaaaatgtaaaagagaacctgcaacagaacatctataaaacgattattcctagaaatatccggttggcagaagcaccaagttatggaatgccgatcaatctgtatgatccaaagtctacaggagcaagcgcataccagagacttgctgatgaagtgatgaatagagagtaactaaaagatgtgatgtaggagggaacgaatgtcaattaagaaaaaaggtctgggaaaaggtctggacagtctgatcccagataataagagcataaagtctgtaacacctgacaaatctgctgaagcaaagaaagaagcagaagaaaaagcaggcgtgcagacgatgaagatcaatgaggttgagccgaacagggatcagccgagaaagaattttgatgaagatgctctccttgaactttcggattccatcaaacagttcggtgtattacagccgctgcttattcggaaaagaaaggattactacgaaatcattgccggtgaaagaagatggagagctgcaaaacttgccggggtaaaggaagttcctgtaattgtaaaagaatatacagatcaggaaattcttgaaatcggtctgattgaaaatatccagagagagaacctgaatccaattgaagaagcaattgcatttaagagacttctggaggaattcaatctgaaacaggatgaagttgcagaacgagtatcgaagagcagaactgcggtaacaaactctatgagactgttgaagttaagtgataaagtacagcagatgataattgacgatatgatttctacagggcatgcgagagcgcttctcgcaattgatgatccggaacttcagtatacactggcaaataagatatttgacgagaaactcagtgtgagggagactgagaagcttgtgaaagagatcaagaatccgaaaaaaccaaaagagaagaaggtaatggagaatgcgttcatttaccaggatctggaagaaaagatgaaaggtgtattcggaacaaaagtcagtatagcatcaaaaggaaagggaaaaggtaagatagagatagaatattattcagatgatgaattagaacatctgttcgatatgatgatgagcattaaaagaggagagtaattgaatatggatagcaaaatactgaaagcacttggtatcgatccggcattgatatttttatttttgctggtactgattgttatattattcgttctgtatgtaaatgtaacaatgaagtataatcggttgaaaagcagctatacgacgtttatgcgtgggaaagatggaaagacactggaagaaagcatgatgtcaggattttcggatgtagaagcaattctgaaatacacaaagcagaatcgtacagacatccaaaagctgaacaagaagatggagaagtcttaccagaaggttggtattgtcaagtatgatgcatttaatgaaatgggtggaaagctcagctttgcacttgcaatgctagacaataataataccggatggatcctcaatgcaatgcacagcagagagggctgttacacttacgtaaaggagattgtaaaaggggaaagctatgtagaacttgctgaggaagaagcagaagcactggataaggctattttcgaagatggatatgaagaagaagtcaataaggctgttgcttctgtaacaggaagtatgaaaatggcaaaatccggtccggcaaagaacggaaatcagaaaaacagtaatgcaagaagtgcaaaacaggcatctggaaaggcaaataatggaaaaatcctgaatacaagaaccagcagtatgcgtccagatatggcaagacctgaaaaaaatagaaaatagcagatcatataacagatatgagagcaggaggagtttagaaaaatgttagatatcaaatttgtaagaaataatccggatgtggtaaaacagaacatcaaaaataagttccaggatgagaaattacctttggtagatgaagtaatagaactggatcagaagaatagagatattaagggagaagtagaagcacttcgtgcagaaaagaataaaatctctaaacagatcggtgcatgtatggcacagggaaagaaagaagaagcggaagaattaaagagaaaagtagctgagagtgctgcaagaatcgaagaactttccaaagaagaaaaagaagtagaagagaaactgaaacagaatatgatgattattccgaacatcatcgatccttctgtaccaatcggaaaagatgacagtcagaatgtagaaattgaaaaattcggtgagccttttgttcctgatttcgagattccataccatacagagatcatggaagcatttgacggaatcgatcttgagagcgccggaagagtagcgggaaatggattctattatctgatgggtgatatcgcaagaattcattcttctgtacttgcatatgcaagagactttatgatcaatcgtggatttacttactgtgtaccacctttcatgatcagaagcaacgttgtaacaggtgttatgagcttcgcagagatggattctatgatgtacaagatcgagggagaagatctgtatctgatcggaacaagtgagcactctatgatcggtaaattcatcgacacaatgctggaagaaaaacagcttccacagacacttacaagctattcaccatgtttccgtaaagaaaaaggagctcatggtatcgaggaacgtggagtatacagaatccaccagttcgaaaaacaggaaatgatcgttgtatgtaaaccggaagaaagcaagatctggtatgataaattatggcagaacacggtagatctgttccgttcactggatatcccggtacgtacattagagtgctgctcaggtgacctggcagatctgaaggtaaaatcttgtgacgtggaagcatggtctccaagacagaagaaatacttcgaagtaggaagttgttctaaccttggtgatgcacaagcaagaagacttggtatccgtgtcaaaggtgaagacggaacaaaatatttcgcacatacactgaacaatacagttgtggctccaccgagaatgctgatcgcattcctggaaaacaaccttcaggaagatggatctgttaagattcctaaggcattacagccatacatgggcggaacagagaagcttgtacctaaaaaataggaaattataaggataagcgtatgcatcaatatttgaaatccattggatttggaaatatcagagacaaaaaacagttaatacagatcataagagatgtggaagaatcctatacgggacatcagcttgtcacgcaggatgaagtgacggatctttgtgaatttgataaagaatatggagaaggtatcgggatcaaggtgtgcggagatatggatatcgacgaacagtttgattaccgctattatgctccgtatttcacaggatccggcgtaacatcttatgcaaatgtcagtgtggaacgaaggatagaccgtgaagcatatgtaggcatttgtgaggatacaaaagttggcatcaacctggtattctatctgcagaatatgatggaatatctgagagagaggcagattggcggaagaagtatcaagtattcttctgttactttgtccggactctgtaatgagggaaccatcctgcttccggtgaggaaaagcaaggagcaggaacgggaacagcaggaagaggtgcacaaccgcatgctgttgttgagtgcagccagaacaggtgatccgcaggcaatcgaaagtcttacactggatgatatggatacctattccaaagtatcgaaaagactgatatcggaagatgtatttaccattgtggatacatacattatgccttatggaatcgaatgcgaccggtattcgatcatgggcgagatcttggaatatcgtcttactagaaatgagattacaagggaagatatctgcattatgaaattggatgtgaacggattattattcgatgtatgtgtaccaaaaagagaagtcatgggcgaaccggcagtcggacgcagattcaaaggaaatgtgtggctgcagggaaaaatcaatttctgaatgtggataagaacagtaaaatgtggataaatatttcagaatgatacaggggtggggatatccatccctgtattgacttttgtgagattaatggtaaaatagatatgtgtcgtcatagctcagctggatagagcactcgcctcctaagcgaggggtcggaggttcaaatcctcttggcgacgggcttcaaagcgttcgaaaatgttagctggattagctgacaacgaacgcttttgttattttcaaatcacgttcgtgacacaaaattccattcaaaatgatcaatttccagctaacgcaatccgatttttgttagctgacagctaatcaaaattatcggtttgcaaacatgggttttaagaagtccagctaacatttgggttccgctccgttgtcaccccttattcggggatgtaaatcagagaaaaggcgggaaaagaaacaatctctcccaaacttgcaaacatgaattagctgaaacagtattcaattctattagctacagctaatggtcaaacagcaatgtctgtttggaactttactatctataaaagttccaggcaggcattttttatttcctgaatcctggaggaaaggagtcgagatgactgagccaaatagacaatcaggagaaaacgaagaaagaatcatagaaattgagattgagcgtcttcgtccgttcaaagagcacccgtttcaggtaaaagatgataaggaaatgtttcttttgcaggaaagcattgagaagtatggaattttaaatccgctaatcgtcagaccagtaccggatggatactatgagatcatatctggtcacagaagaaaacatgctgcggagaaactgggataccgtaaagtaccggtaatcatccgggtattaagtgaagatgattccatcttgagcatggtagattccaatcttcacagagaacggattagttacagtgaaaaagcttttgcttacaaactgaagaatgacgtattaaaaagaaaaagtggtcgaaaaaagagccaagttgaccacaaaacaccaagaaagcgggcaatagaaatcatcagtgaagattgtggtgatagcccaaaacaagtgcagcgttatatctcactgacaaaactgataccggaaatgttgcagaaactggatgatgagattatttctttttgtccggctgtagagatagctgcattaagtgaaaaagaacaaagagaactgcttgtagcaatggagtatgcacaggcaatcccatcactctcacaggcccagaggatccggcaactgagtaaagaaaaacagttgtcactggaaaagatggaagagatcatgtgtgaagtgaaaaagggtgagatcacaagagtggcattcacaaacgagcagttgcacaagtattttccaaattcttatacaccggcaatgatgaaacgggaaatactggcactgttgaaattatggaaaaaagaatcatgggaaagttaaaggaggaagaaatcatgtgtaaagttatatccgtagtaaaccagaaaggtggcgtcggaaagaccaccacaaccgtaaatgtaggcattggactggcaagagaaggtaagaaagtgttgctgatcgacgcggatccacagggaagtttaaccgcaagtcttggatatgaggaaccggatgatcttcgcatcacattggcaacgatcatgatggatgtcatcaacgaagaagaaatctctctggaagatgggattttacatcaccaggaaaatgtagatcttctcccggcaaatattgagctttccgcactggaagtaacgatgggaaatgttatgagcagagaaatgatcatgaaagaatatatcgatgcgatacgatgccgatacgattatatcctgatcgactgtatgccgagccttggtatgatgacaatcaatgcactggtctcttccgattctgtgttgatacctgtgcaagccgcatatctgccggtgaaaggacttcagcagctgatcaagaccattcttacagtaaagaaaagactgaaccggaaactggcgattgagggcattctcctgaccatggtagatttcagaaccaattacgcaagggatatgatatgccaggactggcaagataggaggtgcacatgtttattttaaaacttgctgggaagatattattactgccggtatggctgatcctttttgtgatcggcctggcagtaaagatgacagtacagacttatgcggttgtcagagggatccttgggtttatattcactttgttgattatagcgactgcatactgttatcatgactgggtacaggttgcatttctattttcgctgagtgtaattctgtatctgatcctgtttgcaggagtgtttgtagatactgtactggacatgacaagagaacgtattattgattttattatatcgtgaggagaatatgaaaatgagcgaaaacaatgattatattcagttaccaccactaaaaaaagacacaccgtccgatgtggtagcatttatctgggagtacatgaaagtaccggagaactcaagagaaaaagttaagaatctgcttaaagatgcaaatgaaaatggcgtaaaattaagtcatcaggcaccaacactgtatgatgttgttccaaaagaagaaattgctgaatttgaagagcttatgcgcaaaaccatagctgacattgtatcagaagccagtagcgttgcctgttgggtgtatgtgcagaaatatgtgaagcacaaaaccctaaacgaaatgctgcaagaattgccagacgtaggtcaattcatcctagctatggatacttggtttgaaaaactgatggagaaataatctaggaaaatagtttaaagtttacatgttatgatcatgtatgaagttggaacaaaataaaagaattgtgctataatattgttcaagaaaaagctcattgacatatttcaatctatttaggaggataaacgatcatgtgtacagcagcaacttataaaacaaaagatttttactttggacgaaccctcgattatgaattctcttatggtgatcagatagtaattacaccacgtaattatgcgtttaattttcgccatgttggcgatatgaaaaatcattatgcaattattggaatggctcatgttgctgaggattatcctttgtattatgatgctatgaatgaaaaaggagtggcaatggcaggactgaattttgtcggaaatgctgtttatgccgcgattaagccagatgtggaaaatattgcacagtttgaatttattccgtggattttaagtcagtgttcttctttagttgaagttcgcgagcttcttgaacgaattaatattgttaatactcctttcagcgagcaattaccattagcacaattacactggatcatttctgatgagaatgagtcaattacggtagaatctatgtcagatggtttgcatatttatgacaatccagtaggagtgcttgcgaataatcctccatttccacagcagatgtttcaactaaataattatatgtatttatctcctaaacagcccagaaatactttctgcgaaaatttggctcttgatgcatatagtagaggtatgggaggattaggtcttccgggagatctctcatcttcctcacgctttgtacgtgtagcttttacaaaggtaaatgcaatttcaggtgaatcagaggaagaaagcgttagccaattcttccacattctcggatctgtggatcagcaacgaggatgttgcgaagtagcggatggaaaatatgaaatcacattgtatacgtcgtgttgtaatgttacaaaaggtatttattattacaatacttatgaaaaccatcagatcagtgcagtagatatgcatgtagaaaatctggatagtgataaaatgatttgttatccagtaattcaaggagaacgaatcaactatcaaaataaataatgttttgaaatcagggatgaggtagaaaggaaagttccatgacaaaagatgaagtaaaaaaactcaggatgaacagtccggaatcactacagtttttaaataatgctacaaaattttataatttaatgatgatgtatcgttgtgctattcgggagatacaaactaaacttgaggttttggatgatgaattttcagttgagaacaatcgaaatcctatttcttttataaaaacaagaattaagcagcccaatagtatttacgataaactgcagaagatgggatatgaatttacaacagaaaatatacagacatatctcaatgatgtagcaggcgttcgaatagtttgtgcgtttattgacgatatttatatgatatcagatttgattacccaacaggatgatattaaagttattgaaataaaagattatataaaaaatccaaaatcgaatggttatcgaagctatcatatgattgttgaaataccagtattttttgctaagggtaaaacacctatgcgtgtagaattacagattcgaaccaatggtatggatttctgggcaacattggaacatcaacttcgctataaaaaaggaattgaagaaatgcctggctatgatgagataagtgaagaattacttcattctgcaagagctatcattgaagcagataatgaaatgcagagaataaaagacaaaattggtatgttccacgaaatttaggaagaaaactgagcaagtaggaaggtggaatatatatgaaacaagatactttagagggcaaagcaaaaacaaaaaatggggtaaaacggctgtgtttttccataatctgcattcttctggaagtgatttttattattactatcgtaacacgcttgaatgaatatgcagaaatcataaatttatttacaaggattttgagtgggatcttggttttgggattgtacgcatcaaataagacatcctctatgaaaatgccttgggtcatcttaattctaattttcccaattatgggtgtaggcctgtatttgttgattggtttgaatggtggcacacataaaatgcgtgagcgatatgcagaaattgatagcaaattgttaccaatgcttccggacagtcaggagtgtttgagcaaaataaaagaaaaaattccgaaagcaggaaatatagcaagttacatacaaagaaattcgcagtatccaatctatcagaatacggatattgtgtattttgatgaagcagtgaaaggattagaggcacagcttaaggatttggagaaagcacagaagtttatctttatggaatatcatgcgatagaagacgctgaagcatggcataagattcaagatgttctggaagagcgagtaaaagcaggtgtggaagttagagtattctacgatgatatgggttctataggctttattaacacagattttgtgaaaaagatggaagcaataggaattcattgccgtgtattcaatccgtttatgccaggtttaaatctgtttttgaacaatcgtgatcatagaaaaataacagttattgatggaaaagtcggatttacaggtggatataatctagcaaacgaatattttaattacacacacccgtatggacagtggaaagatacaggtattcgtttagaaggagatgctgttcagtcgcttacggtgacatttttggaaatgtggaatgcagtaagtgataaggatgctaatgattctgattttagtaaataccttttccactatgattatgcggcacagcaaactgggtttgttcaaccttatgcagacagccctatggataatgagcaagtaggagaagaagtttatatcagtatgataaataaagctgaaaaatattgttggtttatgactccatatctaatcataacagatgaaatgacgcatgcgttatgtctggctgctaagcgaggggtagacgtaagaattatcacacctggtatccctgataaaaaattcatttataatataactcgttctttttatcatggattagttaaacatggtgttcgtgtttatgagtggactcctggtttctgtcatgcaaaaatgagtgtggcagatgactgtatggcaacttgtggaacaattaatctggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactgggacaattatttatgagattatttgctggattgctataagaatctgatgaaacgacctttcaaaaaacagttgatttagaagttaactgtttttgaaaggccgtttttgctatatctaacagtctgttgtacaaagaagattttgcatggatagtgattaatacaacggagtaagaaaagctccttcatatattagaataaaaatatgactgtttctttaaaaagaagccggtcatatttttttatgaaaaataaattttgttgaggttaaattgagattgactttgtattgtataagtatgaaataaaaaggaagcaggtgatgtacaatgaaaaagcataaaatatgtaaaatccttcttgttatactggcaatttttttatgtgtggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgatcaagaatgcaaaaaaggaaattattctttctacttttgcatttcaatccgatgaaagtggaaaattgattttaggagcactgcatgatgcggcagacagaggtgtacatattcgtctgttagtagatggaatggagagctggattgatatggaaggaaatccgtatttctatggattatcttcccatgagaatgttgaaattaaactgtataataaggccaatccgttgaaaccgtggaaaatgatgggtagaatgcatgataaatatttgattgcagatggaaagagatatattcttgggggaagaaatacatataattatttcctgggtgattttccgggacataagaactatgacagagacgtgttagtggtttgcgatgaacctgagaaagaaaattcagttaaccagttgtcagagtattttgaaaccatatggaatcaggaagacagtgattattttcatgacaataaaaaactggcaaatagaaaatctgtaaagaacgcagttttagagctgcagaacggctatcagaaatattttgaagagaataaggaaagaatctgcgatactgattacacggacgaaacttttgagacagaaaagattgcattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaggagattgcagagaacgtttcagatttttctatcatgacaaattcagttgcgaataatgggaatccatttgggtctgccgattatgcgaaaaacagaaatagaatcttaagtacaggaattaatatctgggaatatgaaggcggttattcataccacggaaaaagtattctgattgacgatgatctgtctgtaatcggttcctttaatatggacatgagaagtgcatatctggatacggaactgatgcttgtaatacgcagtaaagatattaataaacagttggaagagggcatgatggaatatgaaagagtgtcccgccaggtattggaagatggaacctatcgtgatccatatcatgtagagccaatcgaattaacaaagaaacgtcagagaaaaatatttttggtacagcatctgcttggatgggcaaggtatctgttttaataaggaggaaggaaaacgtgtttcaaatattgattgtagaagatgataaagaattaagccagctattccaaaaagtgcttgagaagaatggatatcaagtcaaaagtgcatcggatggagcacaggcattagaagtattggataaggaatatattgatctgatcatttctgatattatgatgccggttatggatggctatgaactggtgtcagaacttcgttcagcaggatatcagataccagtgcttatgatcactgcgaaaggttcctttgatgatatgcgccagggatttctttcgggaagtgacgattatatggtaaaaccggtaaatgtgaatgaaatggttttaagagtcggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagagagcgttttaaagataaccctgattttgaaatcgtaacaatgcgtggaattggatacaaggtggtgaaaaaataatggaacaaaagaaagaaaaaggattgcggatccgatcctgtctgactggtgcaatctggctggcacttgtattttcaacagtcatatctgctttattatttgcttttttgaatcatttttttaatctgccgggcagcatacctgtgcttggctggcttttgattttcaatacattgattgcagggctgatcacttcctttatcaatgcaaagttactggaaccaattaccagacttagtaaagcaatgaaggaagtttctcagggagattttgaacagcatttggaaacgaacagccgtatagcagaagttggagaatcttatcaaagttttaatgttatgacaaaagaacttcgtgcaacagaggtgctgcagatggattttgtatctaatgtttctcatgagtttaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagcccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcagatttgttgtagagcttccaatacagaaagatgaggccatataagtttaagaaaaacagatagaggaggaattacatgacattttatcaggaattgcagttaaatcaggcaggttctaaaaatctgttgaaaaagagtgaaacagtgaaagaaaaatcatatcatatactggtatatttggtaaagatagctgttacaatggcattttgttttttatttgttactattttcagtatcttatttggaaatgagaatagtattgtgggtgtagtagttttattatgccttatggtatttcggaatgcggatctggggatccacaccggacaatctacgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacgggaaaaagctatcagatgcgattagtcggaatggctttaggtgcagcacttacctgcttcgtattttatcgaaatcataaaaacagaacttataaaagaaatctgaaagatctgatacaagaatttgatatcacttcttccagaacaaaatggcagatatgtcagattttatgcgtaccgattgtcctttgcattgcagaactttgtaatatgccacgtgcaatgtgggctggtattgcggccatgtccgcgattttgccatttatggaagatatgcactacagagtccgtaaaaggattgtcggaaatattgcaggtgttatatgttttacagtattatattttctgcttccttcgtcaatctatgcatatataggaattcttggtggaatcggtgtaggactttcagcacaatatggctggcaggcagtatttaacacatttggtgctttagccattgctgcagagacttatggactacaaggagcggttagtcttagagtgattcaaaatgtttttggtgttgtgtttgcattagcattttgtgttatattttattggtttatgtcaaaaaaaaaggaaagtgaggcgaccgtacatgcagagtgaagtgaatcaggaagaaaatttgaatagaattattacggttcctaatcttctttctttttttcggctttgcctgattccggtaattatatggagctattgtgtaaagaaaaatcctctgttagctggagaaatcttattgctgtctggtcttacggatcttgctgatggatatatcgcaagaagattccatatgattagtaatttgggaaaaatacttgatccggtggccgataagctgacacaggcagcgatgttaatctgtctgtttactcgttttccgcatgtgcttcttttaatcgcaataatggcaggtaaggagctgtatatggtagtcagtggatgtcttgtgatacaaaagacaggaaaagtacatggtgcagactggcatggaaagatagtaacctttttattatatggaactgcagcggtgcatattatatggttccacattacaccgatggtatcagatctgttgattggtttgtgtgctataatgatggtcatatcggtcgctctgtatattatccagaataccaggactcttaagggagagactgtataagcaattttatattgcaatgactagaaaaatatttaggagaagatagatataaacagtaagtcaaacacacaaactatggagtctttagtcggtttaataaaattttagatagaaaataaatcattataaaaagatcctgttcatactatgatatatagaacaggatctttatttactttatttcgccaggaaattgctctgaatctccatcggcatatgataagcctggcctcgttttgtcaggctgtataatttaaagctcattagttccggagtcgcattcaatgaactgcagagtccgaaataatccaggtcctcgttctgaaccatatcttcgatttcctcatcttcaatcagcagatcggcagcaaacagattggcctggtattctgtattatccgtcatattgtagagtgtatcatcttgcatacctgggttggatttatctttatggtaattgtgttagtagttgtaatgcagatatttgaaaaggtgaaagaacagctgcttaaatggacaattgattaaaattaaatgaagatgaaaatatagggaagttgtggtatatggatgtgtatcacagcttcccttttttaacaaaagctaaatgcgtttcataagttacactgcaatgtccggtgtccagtagatattatttatcaatctcactcagtgcagcttcatcagcaacgattgttacatcattatgtaactgaaggatggaagccggtacttccggagtgattgctccatagagtacttgcctgttgggtgtatgtgcagaaatatgtgaaacagaaaactctggacgaaatgctgcaagaattgccagatgtaggccaatttatcattgctattggatagctggtttgaaagactgatggcggaagaatagatgctgtgatagaatgaagaaaaatgataagttaataaaatgatatcaaaaaaatttacatctgataaggagaaggaaaatagatggaaagtgtgaattatgaatattttgattcagagaatgattattcaaaaaatcctaatgcaaccaaacatagatcatttaacgtttcaagaggagattttagtaaatatgctattttaaatggattttacggaaaaaaactgatttctcgagatgcaagaaaattttattcatcaatgtgtagaatggcagtaaaaaaggaaaaagggttttatgtaatttcagatgagtatgaatttgcggaaacttcatataaaaatgtaatttcttttgccatgggtatgttagcaacaagaattattgcaaatgaaatatataacattaacaaattatatcattttacagataagagttttaaaggaacgttggtgaatggaaaaatggcaccagattggatcggagttgatgggcaaaaaaaagtatttttatttgaaagtaaggggacttgtaataagaatgttaggaaaaagacaatcgagcatgcaaaagtacaattaaataatgtgggttcaattaaggatacatcaacaaaccagatgtattacccacaaaaagatagcaaacatgtaatttgttcatgttttgacgcatactctggtatagataaagtatggaatatacatgatgtggatccagaaggaaagggagaagttaacttagaaattaattttgataaagaatgctttatgtattatcaagcatttgtttcgtatgtggattcattaaatcaggtatatcaatgtgagtctgtaaaaaatcaaaaatactattgttgggtgtatgaagatgaaaaatattgtattcttgaagaaatatataattcgatgaaatcaggacaatttaatgaacagaatagatatcgtaattttaataattatgtaaacgagaaacttagtgatatagagtatccagaacagttttcacatgatggaatctcttcctatgaagatggaatagtagtttgtagttcagtttcttggcgagataagctgcactaagaagatatttttgtttttgttctcatactcctccttccgctgagactattcctcccgccgggagttcacgtatttcaatatcggctgtcccttccgatattagaaatagtgctgtgaacacctttaggtggaaccaacagacaagtgaaacgtctgttattgagagggtatggggaaatccccatcaagataaatcccataggagaacaggatggcaagcgacattactgttaaacatgggtggatcttgcccttatttgtatccctctatataacgaaacgctcagaggctgttttacagtgggggaaaagaaaaaatatcaaaaaattgataattaatggtgagcttgtgatagaatggaaaaaagagaaaagcataaaggatgtagttgtggagaatatttgttatgattagaaagttgctgaacggagatatcgatagagtcgctgacatatggttaaagacaaatctgaaagcacattattttatttccaatcaatattggaaaagtaattatgaattagtaaaagaaatgctgtcacaatccgaagtttatgtgtttgaagcagataaaatgatacaaggatttgtaggactaaatgatgaatatatatgatattgtaaagacatattcggaaaacacgcttggaaagttttcaaaacatgatgcattggttgcctgccctagccttggaagttcttcagtagaatcagcacttaaaaagctggttgatgaggggactgtcatacggactggagcaggaaggaaaaaaatgtatatgatgaaaaaagaataattattacgaggatacattagagatataatataaatattgataaaactatttacaaaagtggggaataaaaaatgaacaaacaaaagaaaaaaggtttcacatcagacacgttaaaagaaaccgccgtcatgacgatagcagtggggattatcgccgcggcagtgtatttcttcctgattccgagtcagacttcgatcagcagtatatctgcacttgcgattattatcgcacattatgtaccattgcatgtgtcaacggttacgatgatcctgaatgtggtcttattgctgatcggatttgtaacttgcgggaaagaatttggggcgaagacggtatatacgagtatcttgctgccagtgtatctggcggtatttgaacatgtatttccggattttgaatcactgacgaacagcaatgagctggatgtgttatgttatattctggtggtaagtattggtcttagcattttattcaacatgaatgcgtcatccggtggactggatatcgtagcgaagatcatgaacaagtatcttcacatcgaactgggaaaagctatgtcaatttcaggaatgtgtgtggcactttcgtctgctctgatctatgataaaaaagcggtagtgttaagtgtgcttggcacatattttaatggtattgtgctggatcatttcatctttggacagaatgtaaaaagacgagtctgcattattacaaaatacgaagaagaggtacgacagtttattttacatgagctgcacagtggagcgacattctatgaagcgatgggtgcttataatatgcagaagtacagagagattattacgattgtagataagagtgaatatcagaaactcatgaactatattgtccagaaagatccggaagcatttgtaacggtgtatacagtatctgatatgcgctacagaccgaaggtgagatcattctagttcgtaatgatagataattgccaagaagatgccaatggaaggttctgtagataatagataaatagggaaaaacgtcacatgtgtggcgtttttctgttaacaagtatttgaggaaaagtattatgaagatatatgtggatgccgatgcctgcccggtggtagccatcgttgaacagatcgcaaaagaatatgagattccggtaactcttctgtgtgatacgaatcatgtgttatattcggattacagtgaggtagtgacggtaggagccggagcagatgctgtggactttaagctggtcagtctctgccataaaggtgatatcgtggtaacacaggattatggtgtcgcagcaatgattcttggaaagggagcatatggaatccatcagaatggcaaatggtatacgaatgagaatattgatcgtatgctgatggaaagacatctcgcgaagaaagcgagaaatgcgaagaagaagcatcatctgaaaggtccgtcaaaaaggacagacgaagatgacagaagatttgcagaatcatttaccagacttgtggaaaagcggttgaaaacggagaatgaagcgtgataaaaataaaagaagtgaaagagcagaaggcgataaaaaaagatgaaagaagataagaacgaatcaagatgggacaagcttttgaatattcggacgatgggacgagatgacactcatgcagaccagtatcgctacccttacgaaccgacgccgtattctgtgctggaaaggctggcaaatgcaggatatatccgtaaggggaatatactgcttgattatggctgtggaaaaggaagagtagacttcttcctgtcatatcagacaagatgtaagtctatcggaatcgaatatgatgagcgaatctatgagaaagcagcagagaataaaaaagatgcggtatcgtccggaagagtggagatagaacttgcgaatgcggaagaatttgcagtaccggagacggcagactgtatgtacttttttaatccattttcggtggagatattaagaaaagtgatggcaaggatattagaatcttattatgcagagccgagacggattcagttattcttctattatccgtcagatgagtatatatcgtatctgatgacagtggaggagctgatgttcatagatgagatcgtatgtatggatctgttcccgggagaagatccaagagagaagattgcaatattcgaactggattatatggaatagatatccggaagaaaagataatgtgatatgatataaagtaacacaagatataaggcaatacaaaagaagagaggcgaatcctatgaagaccaaatggaaagtaatcattgcggtaattcttgccgtcgtaatcagtgtcggctcgatatccgcatacaagtatattaccagcccaaaagaagaaagtattccactggaaaccacgcttgaagatgcggcggaactgactacccagaagatgatcatctcagatgtattcaaaagcacaaagggtaatatcccgctgatcaacaagaacaaattcctggtgcagtataagacaatggttactgctggcctggatgtgaaaaaggcgaagattaaagaaacagatgatgagatcagaatcactatcccacattgtacgatcaacgaagattcaatcaagatcaaatccagtgatctgaaaatctatgacacgaattttgcaatcatgagtattgataaagaagctgtgatagaagttgtcgcagaagcggaagaaaaggcaaagaaaaaggccgaatccgatgaatatggtttccttgataatgcagatgagaatgcaaagaaagtgatcaaaggcatgtttgaaaatgtggccggtgaaagaaaggttgttgtagaatttaagtaatcacagaattttagtgatataagagaataaaatgcataaaagatctttcaacttgtttttatacaagatatgctttatactcacatctttgacagttgattagttaaaaaagtgccacaatccctgtaaacaaggggtgtggcacttttatctgcatacacgaaatatagtaatgttttatctccgcttactttttttctgaattcctttcattttccgttttgttatgaattgatagtccgttttaaatccgcaggtttcatggaaatcatcagtgatttcctgacgttcatataccggcatgaagccctgttcttctaatgtacctaattttcggatggttttggaagtacttttcccattggcatttgcattttgtgttttgaagatataaaataaatctctatagaaggagaataagacaatgtcaaaagatgaatatttaattacagatgcgcctcttaaagcgctgactgtttttgcaatgcctatgattctaggcagtttttttcaacaagtatataatatggctgattctattattgttggtcagtttgttggctcatctgcacttgctgcagttggtgcctgcgccgcacttacgaatgtattcatttgtgtagcattgggtgcaggtgtaggtgcaggggttcttgtaagccgttattttggtgcccgggattatagcaaaatgaaaacgattgtgtcaacatcattaattacttttctgattctaagtatacttctgggtctgtttggattttgcttttcccatccaatgatgagtttattacagacacctgctgatatattggatgaagcggtactgtaccttcgagtttattttgtgggatttccgtttctgtttatgtacaatatcctttcaacgatgttcacttcaatcggcgaatcaaagattccgttaggtcttttaatgttttcttcggttttaaatatatttatggacctttggatggtggctggacttggtcttggtgtgtttggtgcagcccttgcgactcttattgcacaaggaatttctgcagtattttcacttttgattttctttagtcggatgcgccgatataaaagtcactttagctggtttgacgggcaggagttacgttcaatgcttcgaattgctgtaccttcggttcttcagcagtctacagtgtcaattgggatgatgattgtacaggcggttgtaaatccatttggtacacaggcactagcgggttattcggcaacgatgagagtagagaatgtattttcactgatatttgtatctattggaaatgcagtttcaccgtatgtttcccaaaatcttggtgcaaagaaaaacgaacgtatcaaaaaaggatatcatgctgcactggtgttagatttatgttttgcagttcttgcttttatagttattgagacattgcatacgcaaatttcttcgttattcttaggaaaagacggaactgctttagcttatcaggtatcaggggattatatgagatggctaggctactttttcattttcatgggtgtcaagatggcaacagatggagtccttcgtgggcttggaatcatgtggccatttcttattgcaaatatggtaaatcttgcaataagattgtcagttgccttaatctgtgcccctcgttttggtattgcatttgtctggcttggtgtaccggctggctggctcgcaaactttttgatttcttatgcggcactcagaaaattatggccgattgataaggtggattcaatttgatatataatttgacaaaacagccgttggagctctcgtttcgacgactggctcgataatttggaacagtaaaaaacagggtgttgatcaggctgattttgccccggatatctatagattaatgaggaaaatcatgataagatagaagcacagaatctgtgatattgcaattaaacgacataacgaaaggactacaaacggagtatatcttgaactgatgttgtatccgtgggattatgcggcgactcgacttgaacttaacggcagaaggtggaatgatcacgctggatcagccgtgttcgatactggcagcaagaagacagtgctggaaggaagtaagccagttgttgagtgtataataagaagaatgaaatagagagaaaaacagaagggaactgaattcatatgtttacgcatgagatgataaaatcttttaatcagttggagatggatgtatataattacatcatcagcaatgaagagaaagtagtatatatgaaagtacgtgaactggcagaggaggttcatgtttcaacaacgacgatccttcgcttttgtaaaaaggtaggatgcgagggatattctgaattccgtttgaaattaaaacaggaagtcagcagcaaggaacagaagaaaatcaatatggatcttactgcggttaaagatttctttgaacgggtgcagacacaggcatttgctgagaatatccaggaagctgtgaagttacttacaaaggcatcgtcaattatatttgtaggtgtggggaattcttcttttataggaaagtatggggcaagatattttaataatgtaggctggttttcatttgctattgatgatccgttcacgccagtatttcgtggaaaaggtgagagaacagctacaatcgcattgtctgtatcaggagagacggaacagacactgatgttggcagaaaagttgaaaagaagagggagcagcctgatatctattacaaataaggcaaactgttctttggcgaagatgagtgactgcaatataaattattatgtttcagagtataaatataaagaagacgaaaattatgatctgacatcccagatggcagtcgtttttattttggaattaatcggaagagaattgaagggcgtccataacgatacagatgatctgtttcaaaatgatatggaagacttatttcattaaggttgtagaatgtaatggtacgaatagtaaccagataagtaacaaaaaaaacagaatacacgaaaaagtatcataatatacaaaaaaggaaaaggaaaacagtgcattttacacaacaaagtagaatgccctgttttttttatgtaacaaattccgtctatatggaacagaaaccagaaacaggaaaaagtactgacaaaacgaaaaatgcttgttatactagcaccatcaaagcaaatgagaaagaaataagggaggaaacaatcatggtaattcgattattttgtgcagcaggaatgtcaaccagtcttctcgtaaagaagatggaagaggcagcaaaggaaaaaggaaaagatgctgacatcgcagcatatccatttacagagatggaacgcgtgattgaaggtgtggatgtagcactgctcggaccacaggtaggatatcagcttggcagagcaaaagaaatctgtgagccaaaaggggttccggtagatgtgatcccaatgcaggactatggaatgtgcaatggaatgaatgttttgaaatttgcatataagcttgcgaaaaataaataagagaaaacaaagatacacaatttaaagcaaaaaaacagagcaaagggtagtagcaaatgaaagagaaatttaacgaaaaagtaatccctataatccttaagtttattaacacaaagggaatacagtcaattaaaaatggtatggtgacttccatgtctcctctgatcatcggatcaatcttcctgatcttgtcaaactttcctgtaaaggcagttgtcgatgtattagagtctacaggaatcaaagcagtattagatcaggcatgtggtgcaacattctccatcagtgcgatgatcgcagttatcggtatcagctatagctatgcgaaactggaaaatcaggaaccactcaactgtgcaattatttcattagcatcattcttgatcctgatgccttcatccataacaacagaaagtggagaagttgttactggaatcattaataagacatggacagcaggacagggaatgatcggagcaattattgttggattgatcgtaccacttgtttactgctggttcttgaagaaaaatatacgtattaagatgccggccggagttccggaaggtgtaacaaatgcattctcagcattaatcccggcattcgtaatcctgacagggactgcagtaattcacggtatctgttctattggattcaacacaacaggtatggaaattatttacaaagttgttcagacaccacttcagaaaatgacagactcccttggtggagcagttctgatgtgctttacaggaccattcctgtggttcttcggagttcatggttcaacagtagttggtggaatcatgacaggactattacaggcaaacagccttgcaaatcaggctattattgacagtggtgtagaacttacaatagcaaatggaggacatattgtaacacagcagttttatgatcagtttatcaatataacaggtgcaggtatcacaatcggacttgtaatgtatatgttcttctttgcaaaatcaaaacagttgaaagcacttggtaaattgggaattattccggcaatatttggaatcaatgagccaatcctgtttggtgctccagtcgttatgaatccaatgcttgcaattccgtttattggaatgcctgtgatcgcatgtttaatccagtattttgcactgtatacaggaatctgcccattatatggagcaacacagatcccatggacttgtccaccgattatctcaggattccttttagcaggatggaaaagtgctttacttcagttagtgatcctttgtgtttcattctttgtttatctgccattcattaagaagattgacaagatgaatttggttcaggagaagaatcagccggtagaagatgaggatgaagactggtaaaatcagaataaaaataatagcaggataggagacaaaaatggacgaaaaatttgaaacggcatgttttcagatcatcacatatgtaggtacagcaagaacacattttatcaatgcaatccagtgtgcgaaagaaggaaaatatgatgaggcagcagaactgattaaacaaggtgatgaagccttttcacttggacataacgctcatgcagatcttttgacaatggatgcaaatggtgaaatttccaatggatacatgcttctgatgcatgcagaagatcagcttatgagtgcagaaggattccgcattcttgcagatgaattcattgcactgtataagagaatcgatgagaaataatcattaagctgagattgaatatagaaacagaaagttgggggcaaaagcccccaacactattatacaaagcaattaagacaacaggaaggaaataacaatgggatttcgaaaagattttctctggggcggcgcagttgctgctcatcagctggagggtgcctatgatcgagatggaaaaggcttgagcattatggacgttgtaactagcggagatgtgaatacaagaagaagaataacaggtgaaatactaaaaggcgagaattatccgaatcatgaagcaatcgatttttatgattactataaagaagatatccgcttatttgcggaaatgggattcaagtgtttccgtacaagtattgcatggacacgtatcttcccaaatggtgatgaagaacagccgaatgaagccggattaaaattctatgatgacatgtttgaggaatgtctgaaatatgggatcgaaccagtgatcacactgagtcattttgagatgcctctgcatcttgtacaagagtatggtggatggagaaacagaaaactgattgatttcttcgtgaaatttgcagtaacttgctttgaacgatacaaagacaaagtaaaatactggatgacatttaatgagattaataatcaggcagatatcggtgacggattcatgctttacgctaattccggggttgtggttaaaccagaagaaaatgtagaagaattgatgtatcaggcatctcactacgaactggttgccagtgctgaagcgataaaagcagggcataagatcaatccggaatttcagattggctgtatgattgcaatgtgcccaatctatccggctacctgccgtccggaagatatactgcaggccgaaaaagccatgcagaaaagatattattatgcagatgtgcatgtaaaaggagaatatcctgtaaatattttgaaatactgggaaagaaaagaccttaagatcgacgtaacagaagaagatctttcagtattgaaacaaggctgtgtcgattatatcggtttcagttattatatgtctttctgtacaaaagcagaaccagataatccggaatatgactaccgcggagaaaaggatcgcataaagaatcagtacgtaaagacaagtgaatggggatggcagattgatccgatcggactgcgctattcattgaattggtttacagatcgctacaaagtaccactgtttattgtagaaaatggatttggagcatatgatacgttagaagcggatggaagcattcacgatccataccgtgtggaatatctgcagcaccacatttcagaaatgaaaaaggcagtagaggaagatggtgtagatttgatgggttatacaccatggggatgtatcgaccttgtcagtgcaggaaccggtgagatggataagcgatatggattcatttatgtggataaacataatgatggaacaggagacttgtctagaagaaagaaagattctttcgagtggtataaagaagttatttcaaccaacggtgaaaatattaattagttgacaggatgactgttaaaaaagaataatgatcgaatcttattatatctgatgtctattaacagtttactaaaaaagagcatgtggagaaaagccatatgctcttttccgtactaaatttcagaaaaatacaaaattttcaaaaaataatttcttgctactgtaaaatatgcaccattatgctggctatagaattcaacttaatgcgatggtgttgaccttagacatatcaatttttccatccaccataacgttctcagcggcagtgacattgacgctgccgtcctcgttgtaagttgcaaccatcagaaccggcatggggaaaatgccttcggtaattttcagctttgttcgcatgataattcctccttgtgatcatattgacaggactgttcatcctgcttataattatctccatgcaaattataaattcaagtactggcaattatgacaggtactatcttatgagaaagttaaatgataaagaactagtttgagacggtgcgattcaatgagttgaaacggtatctgaaaaccatttccgacaagactctcagcacgaatctcaaggagctggaagcagacaaactgatcgtccgtaccgagtatccgcagattccgccgaaggtggaatatgcactttcggagcgtggaaaatcgctgatgactgtgctggatcagctctgtgtctggggcgaggagaatcgactgacagagtgataacttcaagtttgttgaactgaatccgaaaagcattagggcgcagcatcggaaccatcttctttttgttgtctacctataataacgattggagtagtcgattatagacaatgcaatcaaaaaaatctgaaaatatatttatcaacattacataaaagtgtgtagatgcacataaaatgggaatacatattgaaattcaggtagttctgtgatagaatctcattactaaaaagtgtgcagatgcacggaaatggggagtgtaacgatggagattaaaagagacgcttacctacagcagctgatcgagcgaaaagataatggaatgataaaggtgattaccggcattcgtagatgtggcaaatcctttttgctgtttaccatctttaagagatacttactggagaacggcgttgatgttgatcatattattgaaattgcattggatggtattgagaacgaggaattaagagatcccaaggtatgcttcaagtacatcaaggatgccatgaaagacgacgggaagtattatctccttttggatgaagtgcagttcatgccacgatttgaggaagtgctgaacagcctgctccgcatgagcaatattgatgtgtatgtcaccggaagtaattccaagttcctgtccagcgacattgtgaccgaattccgtggcagaggtgatgagattagaatctaccctctctcctttgcagagttttattctgtctatgacggtgattatgatgatgcctgggatgactacatgatctacggaggattgccgcagatcgtaagtttccagagcgaacgacagaaagcggactatctgaagaacatctttgcaaatgtctatctgaaggatgttattgaaagaaataagattcagaacgtggatgagattgggattctggttgatgtgcttgcatctgcaatcggcgcaccgaccaacccttcaaagattgccaatacctttgccagtgagcgccagatgacttatgctaataaaaccatctccaagcatatcgaccatttgacagatgcctttttgatttccaaggcaagccgatacgatattaagggcagaaagtatatcggtgcaaatctgaaatactactttactgatctgggactgagaaatgcacgtctgaatttcagacagcaggagcctactcatatcatggagaacattgtttataacgagctgctgatccgtggctacaatgttgatgtgggtgtcgtggatatcttcgataaggataaagagggcaaacgtgttcgcaagcagttggaggttgactttgtggtgaatcaaggaaaccagagatactatatccaggttgcatatgacatgacttcggaagaaaaacagacgcaggagttcaattctctgcgtaatatcccggactctttcaagaagatcgtcattgtaaatggcagcaaaaagccttggagaaatgatgaaggttttgtcatcatgggaatgaagtatttcttgctgaatgcgaatagtctggaattttaagtcgatttgagttgttgctgtggtgttgttctatttcaaaaaagagtgaaatgatataaataaggccacggctgatttcatgttggaacagccgtggctcagtttatttttttatccgtacaaacgagactgttccgcagattatggttgattggtgtgtgcggtaatatactatattcagaaaaactattcaggagagtgttagtgtgagaaaatcagattgggcaaaatggttgatcgtgattccggcaatgctaggcattgtgttggtaacctatgtggatcgtataacagatatctggggatttggtgcatttatctgccagctgattgcgattttagaattggcttatggtatgcgaatcgcgatgttggcacagagtagaaagaagtcctaccggttaacaccggaagaacgacatgagtatgcacagtatttatatgagaaacaatatcaacgttaccctgctgtggcgaatcagatgcttttggttatggcaaggatgagtatacttcttgacaattatgaacgggctacacaggagctggaagatatttgtatagataaatttaatccggcacagttgaaggtgtattattacctgaaagtggttacagcagtagtggcaggagatacagaagggcttcaagagagccagatgcgttatgcagggattccggatactaaatgtgtatatccgacagaaactgagcttgctgagtggatagagcagagagatacagtgcagatggcagaagcactgaaaaaggcagtgccggataagaaagagcatccggtacggatcagtatcattactttgattcttgcatatagtaccttcttttacggattgtggtatggtataaaccgtgatatgggatatgaagtgagatatcgtttcgcagaaatatcgattgctgttattacaatcagtctggcgattcttttaatctggggaatcgtaagcttgtacagacacaattgccaggcattatccatacagcctggtaaaaacagagtggcattaatgatcatttttggagctgctgcgatatttacacttttgattattggaatgagtggtctgagtgtagtgttcggaatggatggagaggagacggtgactggtcatgacagcaaatatacgtatataaccgtgcaggaggattatggaggcgagcggagatatcgaaccaataatccatttgttatgcagagtatggatggtctgtggtggtcttcggattcttcggatataatggatgctgaagaagataacgaagaatcatcggatgcggatacagaggatttcccagtgacagaagatactcagaacggagatgtggtagaagattatgaggcagaaggacagcatgatggtctgacgattcagaatgcgatgctggcggtctataattatcttcaggagaataatgcacttcaaaatatggccttcagttacactgcgaatgcaaaaggagaagtctatggtattgtcagtgaaacgcaggaaacaaaagatggtaatacggtaaatgtaagatattgtctgtatgacaacggagcgaagacggatgcggatggtaattcttgcgaagaactggtgttagaaaaagtatatccagacggtaattacgagaccgaattggtagatttttatctggtaaatacggatacgatgcaggtgacagatgaacagaagaatacgtggtaaaataaattctggggaagtaggtgcattatatgacaatgggagaaaaaataaaacaactgcgaagtgcaaatgggtttacacaagaaatgcttgcagaaaaaatgaatgtgtccgttcggcaactgtaagagtaattaactgatgttaggagcctcagtctttcggaggttggggcttcgatttgtatctatgatgattgccgggtaactttattgaataaatacacattgacaagcatctatgcgtagggtaatttgatatatagatgattgcctatgtgaggtagcgaaaatggaagcaaaggatatgatactaatatgtaaagcattatcggatacaaatagactggagattgttcggatgctgtcagacggagaaaaatgcggatgtaagattctggataaattcaatatcacgcagcctactttatcacatcacatgaaaatattggttgactgtgggattgtaaatgatcgtaaggaaggcaagcggcattattattctctgaacaaaaaagtaataagagaggcaagttcatttgttgaagctttgggaaggtaggaaatgaaagaagaatgtattatatgtaaagcaccacttatatatcttgaaaaagatgaaatgatggagtgtgtgttatgccataaaaaggaattaagcaaaactagatgtgagcagggtcattatgtatgtaatgaatgccatacaaaaggaatgggtgtaattatagacatatgtcttagtgaaacatctaagaatccgatagaaattataagaagaatgatggcgcagccattctgtcatatgcatggaccagagcatcatgttatggttggttcagcgcttcttaccgcatataaaaatgcaggtggtgagattgatttgccggaagctctgcttgaaatgatgaatagaggaaaagctgttccaggcggtgtatgtggattctggggtgcttgtggcgccggaattagtacaggaatgtttatatcaataatctcaggagcgactccacttaaaaatgaaccttggggtctggctaataaaatgacttctaaggcacttgacgcaatcgggagcattggtggaccaagatgttgtaaaagagattcctatatagccataatctcagcaattgactatgtggcagagaatttcaatatacaaatggaaaagcctgttataaagtgtattcattctgataagaacaaccaatgtattaaggagaggtgtccgtttcatgaataagaaaaaagtcgcatttatctgtgttcataattcatgccgtagtcagattgcagaggtatgcaggtagataaaataattatctacctcctacccgattttagaaattaagagagttctgccacattcttgtagcccagattgaattaatcatcaatgccgtatttattttccagtgcttcttctgctaattccagttcatcttccagtttttcaatcgcgcgttctctcgctttgtatgtctcgaagctaatctctttcatctggtaagcatactcaaattcatcatcaagtttatccagttcgtcatcaactgcgtctacctgttttttcaaagcgtagaattgttcgtgattctcagatgcatttgtagatctttttgcattgtttacactttttgttatattacggatatcgttttcataagaagagaaatcataatccttttcgttcacattctctactgcgttttctgtgttactgatgttatcatcattgtcatctgtatttgatgttacaacttcctgtgtcttaatttctatatcttctgcagcttcattattggatgaggtgcatcctgtaaaagcaaatattaatgtgagggataataaaactactaatatttttttcataacgtgttctccttccatctcttggatgttttgtttttgctgttatatgtatcatatagggggaagattaaaaaaagattaaaacaaatagtaatttcaaaaaatgaaaaaaaggactctggcacacgaaaatgattggtattataataattacattatgagattactgattgtagaagacgagaatgatttaagaaacattgtcaaaaaaaggcttgtcaaggaacattacagtgtagatgcctgtggggatggtctggaagcgatggattatatcgatatgacttcctacgatggtattattcttgatatcatgttgccgggaaaggatggatatgaaatcttaagagaattaaggcgacgagaagatgatacaccggttctgttactgacagcaaaagacagcattgaagaccgcgtcaaaggactggatcttggtgccgatgattacctgatcaaaccatttgcatttgaagaactgcttgcaagaatccgtgtcatgatgcgtagaaagccacaatttacatccaatcaactaaaaatagcagatcttattctggatcgtgacacaagaaaggttacaagagccggaaatgaaattgatctttctgcaaaagaatttatggttctggaatgtcttatgcgcaacaaaaatatcgtaatgacaagacagcagattgaacagaatgcgtgggactttgattttgaaggtggttccaatgtgatcgacgtatacattcgttatttgcgaaaaaaaatcgatgcacaatatgaacaaaaactcatccacactgttcgcggtatcggatatgtaatgagggaaaacgaatgaaacagctgacgatcaagaaaaaaattacgctatggtacaccggaatcattgccgtagttcttgggactattttagttctcgtccttctttttgtggataaggttggaatttctgcgacagaagaagaaatcagtgccgcagtgactggtttctcttcaaatattaattttcaggatgattccttttatcttgacggcgataccgaattttacgatgacggtattatgttttgtatttatgacaaaaacggacgcttactttatggaacgattccaacccaatttccagaagaaactatcctcaagtcgaatacaccgcgaatgataaccggatcaaatcgaaaatggatgatatatgacagcctctacacttacggtgatgatgaggaaatgtgggtacgaggaattacctccgtacattctatagaacttttcatgcagacatccgagaaaatgctgttgattgtattcccattactcattattctgattggagccatcggatattttatgatcaagcgggcattgagccaggtggatcttatctgtgatgaagttgaaaacatcagcaatggaaaagatctttccaaacgattgtctctgccaaaagcaaaagatgaattatacgaattgtcggagaaatttaacgaaatgttcgagcgcttggaattttcgtttgagaaggaacgtcaattcacatcagacgtatcccatgaactgcggactcccgttgctgttatcatttcccagtgtgagtacttattggaaaatgaaaacttatctgcggaagataaggaagagattgcagtcatcttaaggcaggcaaaacgaatgtcaaagctgacaagcgaaatgttaatgatcgccagaaacgaacaggatgagcagcatctgatggaaaaactggattttggattattaagcgaacttgtaatagaagaactgcagacaaaagcacaggaaaaaaatattgagatcaccctgcaaaagcaggacgacttatttatgaacggcgaccagacattgattttgcgtatgatgataaatttaataaccaacgccatcaattacggaaaaataaatggacatatccatgttatcctgaaggtcgaaaatgaccagattgtcggtgaagtgaaagatgatggtattggaataagtgaggaacacctggacagaatctgggagcgtttctatcgtatagacaaaagccgttccagagaaaatggcggtaccggactcggcctttctatggttcgttggattgtaaatctccacaatggaaccattcacgtcgaaagtatcgaaggtatcggaacgagttttattttccgatttccgaaaatataaggagctatcgctgtatatccaatttttttttaccaaagagaagggttcattattcaatgtgaaggtttggatgaagctactggtgaaaaagaaaggtccgtatccgttcaggatatgagccttgcaagaattggagaattgtaatccttagattttcaaataaaaaatagtaataagtgaaatggcaaattctgattgtagaactgacatgtgattataaggaaggaataatatgagaagaaaagatagagaaatcacagatatacacaagattgaaaaaatattgtcgagtgcaaagtatttacatctgggggtattagatgatgaatacccatatgttgtgccgcttcattacggttatcagataaacggcgggaaactaacattttatgttcatagtgcgaaagtggggcataaactggattgcattcggaaaaataacagtgtttttgtggaaattgattacggagaaaaacttatagaagcagatgttccctgcaaatatggtgctgaatatgcgagtgtcatgtgccgagggaaagcaaagatcctccagaatgcagcggataagtgcgcggcacttcgcattcttatgagagagcaaaccggagaggaacacgaaattaatgaaaaaatggtaaatgcggtatgtgtaattgaaataaatgtagattcgtatacggcaaaagcgtgtgtaaaataaattttagtttttggcattattgcttccactggtgattagcctgtattatatttgtattcgtgcattacataaaaataagcatatacatataaaataggaatgaatattgaaatgtatattgttttgtaatagaatatccttactaaaaaagagtgcaggtgaacagaaatagggagtgtaacaatggaacttaaaagatatgtttagctacagcagttggttgaacgggttggagggaaaataatggaatttttgaatagtgaaatgctgaaacgctttatgtatagtgcgccggttaatatattttttaaggatacggaatgtagatactgttttgcttcagagatctgtaatctggtttctgttggggaaaatggaagtatcgtaggaaaaacagatctggaagttcagaagtttccagaaatgggaaaaatgtattatgaggatgataaaaaaatactggctacgggggaagacagccagtatatcagtgaatttccgatggaagatggagaatcactgtattttgagataaaaaagagtgcagtacgggatgaaaacggtaatatcatcggaatcgtaggaattgttgacaatgttactgaacgtgttcgtctggagaagaatgtggaagagctttccatcatagatggcctgacaggtgtgtataatcgtaactatctgaaatacagagtagaagaaaagaaaaaaaatctggtttttccgtttacagtgattatgtccgactgtaattatctgaaggaggtaaatgaccagttcggtcatgaatatggtgatattttgcttaaaatcgtagcaggtaccttgaaggaagaaatgccggaagattctccggttattcgaatgggtggagacgaatttatgattctgggtaatggggtcacagaagaaaaagcctccgaactgatggcaaatatccgggaaagtctgaaacggaaaagcaaagataacatcccgttaagtctggcaatgggcagttataccgtacagagcaaagatttttcctttgacgaagtatgccatgaagccgatttgcggatgtatgcagataaaaaaagggtaaaagctgatgaaagcacattattttatttccaatcaatacggaacaagtaattatgaattagtatacgggatgagagggattggttatggatgattttaaacaacttacagagcagcttttaaaattttatatcgacacggaatccgtagatgatataggctttgaaaacttctttgatgataacagtagtataatcggaacaggaaagcatgagtttttcaggaatctgcatgaatttcaggaatcatataaattcgatgtaaaacaaagaggaaaaatcagacttaaaataagagatttacagcaggaagaagcagagcttggtgatgaccaggtccttgcgtatggatcggtagtctttaccggtttatttgaagatggatccgtctgttttgagatggacacacggtttagcattatctataaaaaggtgaacgggaaatggctggttaagcatctgcatcagtcagtaccggacagagaccagatgacaggggaagaattcccggttacgctgggaaaacaggtggaagaggcgcaccgggcaatcagtgcattagggaccgcttattatcacatctcacgtctggatttaaagacaaagaagatcgaacttgtgaaaagatcccggaaaatggagctgggcatttcgaaaaaaagcgcagactggaattcgcagtttgaggtcatcaaagatgtgatagcagaaccgtttgtacaaaagtacatagatttttttgatacacagaccatggccgcacggcttcgtaataaagagtccatgtcttttgaattcaaaaaaaagaatgggaaatggttccttgccatgatcgttccacagaactatgataaagacggaaatgttacatcggtgctgcttgcaaaccgggatgtgacagatgaaaaactgcgggaattgaggcaggaggaagaactgcgggaagctaaattaactgcggaaactgcaagtaaggcaaaatccgcatttcttttcaatatgtcccatgacatcagaacacctatgaatgcgatcatcggctatgcagatctggcatccagacatctggaagacacagaaaaacttagcagatatatcgataacattcagatatgcggggaaaaactgttatcgttactcagtaatgtcctggatcttgcaagaattgaaaataacaaggtcgaaatgcagtatgccgtgtcggatgtccgggaagactttacgaattgtgttacaatgttccagcaacaggcagaaagtaagaatcagactctgtgtatgacagaacagatcctgtatccgtatgtatatgtggatgaaccacatttatcggaagtctgcatcaacatcataagtaatgcggtcaagtatacaaatgcgggcggtacaatatcctgtaaggttgcacagagaccttgtgagaacgaagactggtgtgatatgatcatcagtattaccgataatggaattggtatgacagaagagttccaaaagcatatctttgaagcgttcgaaagagagcggacttctacgattacccatattgagggtatcggcatcggcatgggaatcgtgaaaaagcttgtggatctgatgggtggtacgatagaggtggaaagtaaactcggtgagggatccacttttacagtgacgatcccttgcaaaaaagcatcaaaagaagaagctttagagaagaaaaatcagaatccacgaagtaagaagtcgctaaaaggcgtccgggtcctgctagtcgaagacaatgagatcaatgcggagatcgcgacagaactgttgaaagaagaagggtgtattgtcgaagttgcaactgacggagttgcatgtatcagcatgattgaaaaggcagatgcggactattataagatgatccttatggatattcagatgccggttatgaatgggttcgatacgacattaaccatccggaagatgaaggatgataaaaaagcgatgatcccgatcatagctatgactgccaatgcctttgcagaagacagacagaaggcgctttctgtcgggatgaatgatcacgttgccaagcctgttgatatgaatattcttgcgccaacgatgatgaaatatttataaaagtggggagtaaaaaaatgaacaaagaaaaaaaacaggttgtcacaccggacaatctaaaagaaattgccgtcatgacgatagcagtggggatcatcgctgcggccgtgtatttctttctgattccgagccagacctcgatcagcagcgtatctgcgctggcaatcattattgcgcattatgtaccgttacatgtatcaacggttacgatgatactgaatgtggtcttactgctgatcggatttataacctgtgggaaagaatttggggcgaagacggtatatacaagtattttgctgccactgtatctggcagtatttgaacaagtatttcctgattttgaatcgctgacaaacagtacggaactggatgtgttatgttatattctggttgtaagcttcggactcagcatcttatttaatatgaatgcgtcgtccggcggactggatatcgtggcaaagatcatgaataaatatcttcatgtcgaactgggaaaagcgatgtccatctcaggaatgtgtgtggcactttcttccgcattgatctatgataaaaaagcggtcgtactgagtgtgcttggtacatactttaacggtattgtgctggatcattttatctttggacagaatgtaaagagacgtgtctgtatcattacaaaatatgaagaagaggtgcgccggttcattctgcatgagctgcacagcggggcaacgttctacgaggcagtaggtgcttacaatatgcagaaatacagagagatcattacaatcgtagataagaacgaatatcagaaactgatgaattatgtcagtaaaaaagatccggaggcattcgtaaccgtatacacggtatccgatatgcgctaccggccaaaagttaaatcattttaacggaggaaaacatatgaagacaaaagctaaaataatcattgcggcagttcttgccattgcgatcagcatcggttcgatagtcatatataagcatattaccggtccgaaagaagagagcataccgcttgagacgacgctggaagatgcagcggagctgacgacacagaagatgatcatctcggatgtattcaggagcacaaagggagagatcccgctgatcaacaagaacagatttctcgtacaatacaagacgacagtgactgcgggactggatgtacagaaagctgtcataaaggagacagacgacaagatccagatatctattccgcactgcacggtcaatgaggattctattaagatcaaatccagtgatctgaagatatatgatacgaattttgcgattatgagtatcgataaagaggcagttatggaacttgtcgcagaggctgagaagaaagcaaaggaaaaagccggatcggatgaatacggatttcttgaaaatgcagacaagaacgccaagaaagtgatcaagggcatgttcgaaaatgtatcgaatggaaaagaagtgatcgtgtctttccagaattagaccggaaatgacggatatgttgtgtaaaagaatgtagagattgtgtgaagaatgtcgaaaaccattaatttctgcaaaagaatgtgctacaataaagaaatcttatatagacaggagataaaaaatgacaatacaggaatgctatgaagcgattggaggaaactatgaagatgtcttaagacgccttcgcagtgaagcactgatccggaaattcacattaaagttccttgaagatcagagttatccactgttaaagcaggctttgggggataacaattacgaagaagcttttcgtggtgcacacacactgaaaggggtatgtcagaatctttcctttgaccgtctgtatgaagtgagcagtgagcttacagaacttttgagagaccggactggagagaagccggggataccggaagcaatggaaaaagtaacaaaagaatatgaggcaacaattgaagaaattaagaagctgcaggagtaatctcctacagcttcttttttaacatttccggattggatgcataagcaagtgccgtgtcagcagtaatgcgtccgtttttataaagtgaaagaagactggaatccatagagaccagatcatttcccgcagaggaatagatgagaccgtcgatctgcgggattttgttatcacggatcatattgcggatcgcaggattgacgatcataatctcgaatgcaggggtgagaccgccgtctgtggtcggtaccagctgctgggataccactgcctgcaggaccatggaaagctgtactgcgatctgtctctgctgatttggcgggaagacgtcgatgatacggtcgatcgtgttggcagcaccgatcgtatgcagtgttgagaataacagatgaccggtctcggcagcagtcatggctacctgcatcgtctcgtaatcacgcatttcgcccagaaggatcacatccggactctggcgcagggaagcacgcagtgccgtgacataattctcggtatcaacattgatctcacgctggcttacgatactccggttgtgccggtgaaggaattccagcggatcctccagtgtgatgatgtgcttgtcatagtttttattgatatggtcgatgatgcacgcgagggtagtggatttcccgcttccggcaggtcctgtgaccagtaccattcctttggagaaatctgcaaaacgaatgatcttttccgggataccgaatgtggcaggatccggcaaagtaaaggaaataatacggatcacgacggacagggagcctctttgtttgaatgcgctgacgcggaaccgtgagagacccggaaccgcaaaagagaaatcatcgtcgcctgtgtcttccagtatgccgatgtcacgatgtccggcaagctcatagatctgttcgataatccgccgggtgtcatccgggaggagacgggtattgtcttccatccggatatcaccatgtatgcgcatagagaccggccgcccggctacgacaaagatgtcggatgctccggcgctgacagccttttcaagtaattctgtggtattcataaatgcctcctgatatcatatagtctttatcattattgtattaattgaatggaattgtcggcattccagtcacttgtagaagtcattttccaacaggtgatcttatagaatgcagaagcagtatctgaatcttcccggtcagacccgactgtagcggaactgtccggataggtgatctggatccggacttccagttcctgtgacttgttgacagctgtctgaaaagaatagatcagggatccgtcgctgccggtgattccaagctgttgacgcacctgttgataatagctgtctgcatcggaagtggaatgatagcatgcctgcaggatcttctctgtctctgcaagctttttctctgctttgttggatgccctgtaataagcggttgtgtgaccggcaagtgtctgtgcagaccgatagctgccggaagcggtagacaatgataacgctgcaagtgtaaccatacagagcacgatgaatatcatcagaagcgatacagagccgatattcgtaacaggaaattttcgtttattcatgaccggcagcctcctttatgctgtatggtgtatggcaggtaacgttcaaagaatagatctttcttccgttgttaagctgccttgcggtgatctggtaagttgtcaggccagccgtaccgctatcttcatcggatgcgtccttttcttttacagttatcatataagcggccttcttctcttcacaggtatcccaggaagaagagtagaaagtctgtgcctctacagattctcctgctcttagaagttccgcagtgctctctacatgcataagagctgcgttcaggtcacgggcattctctgtcaggatgtgtgaccgtgcaaatgctctcagacagacagcacttaccagtgagaagaacagaatggcaatgatcagttcgatcagaaacagagaagagcggctgttggaagttcgtttcattggcggctcctttctgatatcgtgacagaagcagtcgttccatccgtatctgtggatgtgaatctgaaaagtccgggtttgatctcgctgacagagaagtctgcgactgccaggatatctttgccatccgaaggggaagcatccgtgccgtcccggagagtcagttcctttaatttacctttgtaagaatagatataagtggtgtagcggatatcaccggaaccaccctttagtacaagacattcctgtccctgaaaagtcccggctgatataccgctgtcagaatcgttctgacgtatcttttccgccacgtaggcaagagatgtgtggacagtgtagccggtattcattttctgtgcctgcgaactgtatatatgggcagacaggaccagcacaaggaaggaagaaatggcaaatacgaagaggacagcaatcgggaataacaggtcaatgacatgatttttctgcctttggaatctcaacggtgatccgcctccttcctgataatggtaatgtcgggcatgatattggcaccgagcggctgatagtctacaaaatatttattctcatcataatgaagtccgtaatgttttttcaggtagccaagactctgcgggtagctcccttccagggtataacaggtggttacactccgggttatggcattctgaagagtctgcatctcctcctgatccatctttttgttcatggcagtcagcccgcagccaaatccggcaaagatcagcaggaagataagaacagagatgataacattacgcagatatgaagttttacgttctcttataaaacgctgcatatgcatccactccttctataatcctgccataatgctgaccagcggaagcattacggacaataagataatgccgacgatcacggataagatgatgacgagtgtcggttcgattgcagcgatcattccggccatccttacatcaatatcttcatcatattgatctgcgatcttctgcatgatctcttccatggaaccggtacgtccgccgatggacaccagtctggcgtaaagtccggagaatatgtgattgctcaaaagtacttcactgaaatcatttccggatgaaagctcttcccggcatttttccagcctggttcggaatgcgtggtcatcgatcagatccatagtaaggttcagacattcttccggcggcagaccgctgcttaacgtaagtgccataccgctggcaaagcggcgggcagagatcttctcatataactgtctggaattcttaaactttccaaagaaagactggaagttccgagaccgctttttcgaaaagcatatgtagaaaatcattcctgccagtacggcaagaatcagaagaaagaccgcaatatgacggttcaggaactctccgatattcaggatcacaagggaaatgccggacatactgcttccgagctggataaatacctgattgaagaccggcattactttcatgatcaggagcaggatgacaagcagcatcatgacgatcatgatcagcggataagtaaccgcactcttgatggattctgccagagaatcctctttttcataatagacggccagagaatccataacatcatccaggcggccggtctgctcaccgatccggaccatagagatcatgtaatccggataagcgtgtgtatcttccagtgcctgtgtcaggcttccggtctgcataagtgtatcattgaccgcagagagtaattccttctcgcctgcattctgtgaatcttccagcatgatcgagatcccctcgatagaagagataccggatcttaagatcatggcggtctgggaacagaaagcggcaatctctgtattggaaagtggagtgaatgttttgtctgccataaaagtctcctttcatatcccatcatatatggccatatagaatactacatatttcatggtgggattaatacgtatattttacaacataatgactgccgtcgccgacatatttcttaacagcggcactgtcgttggttgcggcaagggttggatccataatctgccaggtattcccgttgaactggatgatatcatctacccagcctttgtcatcaatatatgtgctgatccaggcatggtaggcatctccggagtaaccgacttccagtttggtcggaatattctgtgaccgcagcatgcttgtcataagtgccgcatagtcaaagcatatcccttttttggaagaaagcgtatcatcaatatccgggacatatccgtaagatacgttctgtgctttttctgtgtcgtaagaaatgtttttaatcacataattgtaaatgttctgtacaacatccagatcactgtaggtgtcttttgcaagatcgctgcctttggagacagccttcgaatctgtatggaagttcacatattgattcggatacaggaaaggaaggaattcatcttcgatgctgacgttgatggattgggcaagtgagacggtataagtgtcacctgcgacattttccagaacctgtaaggcataggagccatttccggctgtcagcgggaatgtatcatatgctccgcggtcgctgatcaggtaagtataacaactctgatcgggacatgtgatctgaagctttactttttcatttgttccattgtatttcaccataacatagccctgcgaagtattcgatgtatcaatggaagcaaaatcattctgataaacggtaaccccgtcagctgacggggttaacactctaggcgttgaatctctggggggaccggaatgttcctttcgggatgcggaagaactgccggaacaacccccaagaagaaggcagaatatggcgataagtaaataggataaatgtaatctgtatttcatatctgcaatcctcctgtgtatttataaatcgtctgttaattattatcgaccggtgagagcagaagtaccagctcgtttccggcgttatccggaatcgtaacggttacaggtgcgtccggaaccggatatacaatcattccggtttttgtgtcaaagtgatccggtgcgtatccgccgatattcggatagtcgataccggaataggtatccataacttccaggtagatataaccgtctttggaataagaatccttaagaaccggcttttctttgtcgagatgacggactttgtagaacctggcggccacctgtccgttgaaagagactgctttgatcttcagtgttccgttatcggaaatcgcagccttgaattcctttgacccctcttcctgaagccggaccggagtcccgtttatggtggcacttacggaatgtaaaggaagcagtgtcttgatatgaatactatatatggcatccgaagcggatttgacatccgttcgttctgcgatgatcgatggccggaagaacataagcggaagcaggatcaggacgatcaggaaaatgtatgccagagtccgtccgagattgaagccgtgctttttataatttccccaggattccaggacttcgaccgggactacgctgggttccatatcgcatgcggcaaatacattatccagcaattggttcgctgtctgtgtatccagtttaggaatgtctgtatgttctgtgttgttcaaagaagaattatccggatgaaatacaagggtggcgtttttattcaaaccaatcgcctcccatcttatttttcagcagtttctcaagtagttttttgccttttacaagtcgacgtttgatcgtgctgtggctgcagttcatggcatcggcaatctcatcgatactcatatcgttgaaataacgcatgataagtgcctgtgcatattgcggtggtaattcgagaacagaagccatgagtacggggtggtcgaaatgatccatgagctgcttttccggattgtgtgtcatggaatccggctgcagatgcggatccttttcctgcgtcatctccgtaacacggttaagctcttcttcatgacggctgttcttctgacatacatcaaaacaggtgcggaatgtaatttggttcagccaggagacgaagagccggggattcttcagggcgttgatatttttcagcaccagaatgtatacatcctgaagaatatcctgtgcaagataagcatcctttgcataacgataggtaaaacggtactgcttctgatatgtggcggtataaagttctgcaaaagcctcactatcaccgcgctgagtcttgagaacaagttcggtgagatagttataatctaattcatccatagaacagtacctccttggttagtgcgcgatcgtttcatcggaaattctattataggcaagagcaaccaactgggtaatttcagcaaggtgttcttcgctgttctttgcaataccgatccgatattcaatggaaatggcagaaggtgactggttgtgctgcttaacacggtcggcaatccgggcgaggaaagtattcaactggtcatctgtgcaattttcaaagattgcaagaaatttattgccgccgttacgtcccacaaaacaaagggacagcgcggaggcagacaggatattggaaaaatcttttaataacacatttccggtcgcatgatcataaagtttgttcacggacaaaagattggaaagatctatcatcatacatgtcagattgtcaggaagcgttgtgtcataatacttttcaatgatcgtatcacagctgaaacggttcgggataccggacaatggatcggaatatgcaacgccgtataaattgtgatagtttaatttgaccgatgaaaggatactgaaatcaatcagaagaaatacataacttgcaagtaatacgatccagataatgatgaacagtatcgttgcgggagttgatgcaaagatatactgcttcacttccggctgcatcaaaagatatacactgatcaacgttatcaaaatcagtaaagacaattgtacaattttaaaaatattgaattttttcataacttccctgcttctttttcaaaaatggatattttcatatctgtggtatagatctgtatgaacaatttcagtataacataaactagccgttttgataaataaagaataacataaacccggattattcatgtctgctgtgaataatccgggtttatgttatcaattatctgatttctttaacaaatgatatttccgcttttcctcatacattttttcatccatatgcatcaggaacacttcggcatcatcttcagatccaaattctgcatatcccatggaaacacttagagtgaatggttctatcccggattcattgaaacgggataggttattatgaatctctttcattgtggccaggatactttcttcctcaacacctgatagtaatacaataaactcatctcccgcatagcggattgccataccggcagctggtatagatctaaaaagtatatttcccaacgtacagatagccttatctcccatactatgaccaaaattatcattaatatatttaaaggcgtttacatccatcatgattccatataaagatttacatttcgtaaatttcctttcagaaagtactgcattaagatatctccgattatataatccggaaagttcatccatatataaattctcggcatatgtctgcatctgcacaaatatcaatgcgattgcaactaacacccatgacgatgtgattccgtaaaaaaggaactggataagcacgcctgcaaaacagggaccgacgaaatatatcacgggaaagaaattcacattaactccctgttttttggaatgatacaccagatagatgctgtaagcaaaatataatataagtgagatatatcctaccagtgaaccggcagttcgctgatatacattctccttagatattttaaacataatccctgttccgggcagattacataaaaccataattacttctacgatccaaggaaacattacaactcttacttttttgaatattctcttataattccggtaaatgcgtaattctacatacagacaccaaagcagacctatgctgacggtacctataaaacatatgctgttggagatataattgatctgtctacagccggtaaattgattcccatctaccagaaaagcaattgtctcagacaatgcccccgctaagttcactattgccattccgtcatatagtttgtcttcctcatggagactttctctgtttttccgtctgcaaagcaaaagaaaccacatcattagcacagtcaatccgtttgctatcaatatttcttctataactattatttctatcaccttcctatcaccatgtttttctattatatctccgtgtttccttcaaaacaatacatatcctggattattcataccttttacgtgaaagctggtaaaaatcacttagtgatttacacgaagactgcttcattttttctgaacattaaggcagggaaaagggggcggccgttcttttttgttgagttaaccggggaaaaggattataatagagaacgcgtggaataagacgcaggaaagacaggaaaaggacaaaggatagaatatggagatagatgcaatcaagaagaaagtgttggaagatgtagatcccgagacgcgcagaaagaaaaagaaagagatgcgcatccagagactgatcgtgacattgcagttcctggggatagcagcagtggtgatcctgatcttctatatactgatgggaatctcgactgttgatgggaattcgatgtatccgacacttcatgacaaggacatcgttatatataacagaagatgtaaggaatataaggccggagacatcgtggcgatcgcccggccatccggagaggattatgtaaagcgggtcatagctgtggccggagacatggttaatatccaggatggcaaagtatatgtaaacggagaagaagtaagatacgacggagagataggaacgacagaaaagaagtcgtcaaagatcacatatccactgagagtcggagacaaagaggtatttgtcctcggagataacagagaagtatccagagactcgcgggagattggaacggtgaaagtgtccgatatcgaaggaaagattgagtggtatatgggaagaccataacgaaacgacagaggagaatagaaattatgcgggggaaaaaacagatagcagccgtagttcttgcggtgatatttgcggtgacagcagggatgccgcacagtacggtatatgcggagccggacagcaccgggaatgcccaggcagcagacgcagcggcagatgatacccagaaagaagagaaaaaagaagaagacatgactccggaagagctggagaagaaggcagaagaagatgcttataagatggagatccagtcgaacagctggaagaactggccgcagggaccgggaacatacggagaagcagcgatcgtgatggatgcaggaaccggaagtatcttatatgcgaagaatattgacgggcatgaatatcctgccagcatcacaaaagttctgaccagccttatcgcattaaaatatggcagcctgtcagaccaggtaacattttcgaatgactgtatatcttttatgcagccgggagattcttccgcaggattaaaagaaggaaatgtgatttcgttggaacaggcgttgtatgcgacactgcttgcctcggcaaatgaagcagcctatgcggttgcggaaaatgtcgggaagaatgccgggcacgattacaactggttcatacagcagatgaacgaggaatgcaaaagtctcggcggggagaactcgaactttgtcaatgcgaacgggcttcatgatgacaatcattatacctgtgcgcgtgacatggctttgatcggcagggagatctggcgttatccggaattcttaaagatctgtcaggagcagagttatacgatcccggcatccgatacgacggaagagcacgtatttccgcagcatcataagatgcttataaaagaaaataaaaattattaccagtatgcggtcgcaggaaagacgggatatacatccaatgccttatccacactgatcaccatggctgataacggcaatatgaaactggtatgtgtcgtactcaggacgcatggagcgaatatatatccggatacaaagaatctgttcgaatatgtatttaataatttccagaagattccggtggcagatgagaagaaaccgacagaagtaaaagaattcataatggcatcggatgaaagtgaggacgccggatccgcacagacgggcgggaatgagtaccatccgctggaagatggctatgtgatcctgccgaaggatgtctcatacaaagatacagactatgagattacagacgtagatgaaaagaccggaaaaggaacgatccaatatacttatgacggacatccggtaggaagtgcgacagcaaagttcacggaagaatacctgcagaaaataagtacagggaaagaacgtgtggataataagaaggagaatgtggataactccgggacaacgaagaactccggtggaaaattaagcgcaaagagcatctggacgaatttcgtgcagaaagcaaaagcagcatgggcgtttggccagaagaaatatgccgggaaatcggcttcggaacaatatatgatcgccggaggatgtgtggcactggtgatcctgatcgtcagcctgatcgttgtattgatacgccggagaagataaaagtagaagataaaagacagaggatacatgaaaaataaggtaaaaccccttgacggattttaggattgttgcatataataaaagatgtgaaaaacgctgacgaagacagtaggatataacagaacgcagcagcgagccggggatggtggaagtccggtgcaagtaagatatatctgaatatcacttctgagttgcagattttgaaaggtttcggtaagtgaccgagtaaaaactgacggtattcctccgttacagggaagacatatgatggtatgttaggtggtttataaacgtaagtacagctttcgtcctatacagggcggaagcttttttaattctatgttttaattttatggaggtaaatatgtataagaaagtttctacggatcttaattttgtagacagagaaaaacagacagagaaattctgggaagacaatgacatcttcagaaaaagtatgcgtgaccgtgaaggcaacgagatctatatgttctatgacggccctccgacagccaacggaaaaccgcacatcggacacgttctgacacgtgttatcaaggatatgatcccgagataccgtaccatgaagggatacgaagttccaagaaaggccggatgggacacacacggacttccggtagaactggaagttgagaagcttctcggactggacggaaaagaccagatcgagaaatacggtatggagccgttcatcaagaaatgtaaagaaagcgtatggaaatacaaaggtatgtgggaagacttctctaataccgtaggtttctgggctgatatggatgatccatatgtaacatatgataataactttatcgagtctgagtggtgggcactcaagagaatctgggacaagaagctcctgtataaaggattcaagatcgtaccatactgtcctcgttgcggaactccgctttctgcacaggaagtagcacagggctataaagatgtaaaagaacgttctgcgatcgttcgtttcaaagtagtaggagaggatgcatatttcctcgcatggacaacaacaccatggacacttccgtctaacatcgcactctgtgtgaacccggaagaagactatgcgaaagtaaaagctgccgacggctatacgtattacatggctgttgcacttctcgataccgtacttggcagacttgccgatgaagaaaacggaacaaaggcttacgagatccttgagacatacaaaggaaaagatctcgaatacaaagagtacgagccattataccagtgtgcttacgactgcgcttccaagcagaacaagaaagcattcttcgttacatgcgatacctatgtaacactgacagacggtacaggtgtggttcatatcgctcctgcgtttggtgaagacgatgccaaggtcggacgtagatatgatatgccgttcgttcagttggtagacgaaaaaggtaacatgggagagacgactccgtttgccggattattcgttaagaaggctgatccggaagtattaaaagacctcgacggacgcggacttctctacgatgcaccgaagttcgagcacagttatccacactgctggagatgtgatacaccacttatttactacgctcgtgaatcatggttcatcaagatgacagaagtaaaagatgacctgatcgccaacaacaatacaatcaactggattccggaaagcatcggtaaaggacgtttcggcgactggcttgagaacgttcaggactggggtatcagccgtaaccgttactggggaactccactgaatatctgggagtgtgaatgcggacaccagcattcgatcggaagtatcgaagagctgaaagaaatgtccgacaactgcccggatgagatcgaacttcaccgtccatacatcgacgaagtaacgatcaagtgcccatgctgcggaaagcagatgcacagagtaccggaagttatcgactgctggttcgacagtggatctatgccatttgcacagcatcactatccatttgagaataaagagttatttgaaaagcagttccctgcagacttcatctccgaggctgttgaccagacacgtggatggttctactcattgcttgcaatctctacactgatcttcaacaaagcaccatacaagaacgttatcgtacttggacacgtgcaggatgagaatggtcagaagatgagtaagtccaaaggaaatgcagttgatccattcgacgcactggagaaatacggagcagatgcgatccgctggtacttctatgtcaatagtgcaccatggcttccgaaccgtttccacggaaaagccgttgtagaaggacagagaaagttcatgggaacactatggaacacctatgcgttcttcgtgctgtatgcgaatatcgatgatttcgatgcaacaaaatatacactggaatacgacaagctgtccgttatggataaatggcttctgtctaagctcaattccgcaatcaaggcagtagactatgatctgtccaactacaagattccggaggctgcaaaggcacttcagagcttcgtagacgatatgagtaactggtatgtaagacgaagccgtgaacgtttctgggctaagggaatggaacaggataagatcaatgcttacatgactctgtacacagcactggttgagatctgtaagacggcagcgccgatgatcccgttcatgacagaagagatctatcagaacctggtaagaagcgtggacgagagcgctccggaaagtatccatctgtgtgacttcccggttgtaaatgaagcacatatcgatacagaactggaagctaatatggacaatgttctgaagctggttgttatgggacgtgcatgcagaaatactgcaaatatcaagaaccgtcagccgatcggacagatgtatgtaaaagctgattttgaagtaccggaattttacaaagacatcgtaaaagatgaattaaatgtaaagaatgtaacatttacacaagatgttcgtgactttacttcatatacttttaaacctcagttaaagacagtgggaccaaaatatggtaaaatgttaggaggtattaaagcagcactcgataaactcgaaggaaatgcagcaatggatgagttaaatgctacagatgccctgaagcttgatatcaatggacaggaagtgactctgttccgcgaagatctgttgatcgaatctgcacagatgccgggatatgtatctgagaatgacaacggaattacagttgttatggatacaaacctttccgaagaacttctggaagaaggatttgtacgtgagatcatcagtaaagtacagaccatgcgtaaggaagccggattcgaagttatggataagatcgcagtatcttatgaaggtacagaaaaagcagagaaagtatttgcagacaatgcatctacgatcgcagatgaaacacttgcactggaagttacaaaagcagtacctgcaggctacacgaaagagtggaagatcaatggagaagctgtaacgatcggtgtggaaaagagataatcaaagcccagtttgttagaagggaagtagaaaatgtataatccaagatttgaaaaagacgtatttaaaagagatgtacggaacaatgtaaagacattgttccgtaaggaagtagaagaggcaactccgcagcagttgttccaggcagtttcttatgctgtaaaggaagccatcatcgatgactggcttgcaacacagaaacagtatgagaaagacgatccgaagaccgtatattacatgtccatggaattcctgctcggaagagctctcggaaacaacctgatcaacatgacggcatataaggaagtaaaagaagctctggaagagatgggaatcgacctgaacgtgatcgaggaccaggagccggatccggcacttggtaacggtggactcggacgtctggcagcatgtttcctggattctcttgcgacactgggatatgcatcttatggatgcggtatccgttaccgttatggtatgttcaagcagaagatcagagacggttatcaggtagaagcaccggataactggttaaaagacggcaacccgttcgagcttcgcagaccggaatatgcgaaagaagtacgttttggcggaaatatccgtgtggaatacgatgagacaggaaagacacacttcgttcaggagaactatgaatctgtaatggcgatcccttatgattatccgatcgtaggatatggcaaccacatcgtgaatacactccgtatctgggatgcagaagcgatcgtagacttccagttagattcctttgaccgtggagattatcacaaagccgttgagcaggagaaccttgcgaagaacatcgtagaagtgctttatccaaatgataaccacatcgcaggaaaagaactgagactgaaacagcagtatttcttcgtatcagcaagtatccaggctgcaattacaaagtttaaaaagaaacatggtgatatcagcaaactgccggagaaagtaacattccagatgaatgatacacatccgacagtagcagtagcagagctgatgcgtattcttcttgatgaggagaatctcggatggaatgaagcatgggatatcacaacaaaatgctgtgcatatacgaaccatacgatcatggcagaagcacttgagaaatggccgatcaatctgttctcaagactccttccacgtatttatcagatcatccaggagatcgaccgccgctttgtcgagcaggtaagagcacagtatcctggtaatgaagagaaagtaaagaagatggcgatcctgatggacggtcaggttaagatggcacatcttgcgatcgttgcaggctattctgtcaacggtgttgcaaagctgcatacagagatcctgaagaaccaggaactgaaagatttctatcagatgatgccggagaagttcaacaacaagaccaatggtatcacacagagacgtttccttatgcatgcgaatccgctgcttgccgactgggtaacagagaagctcggaacaaaagagtggattacagacttatccaagatgagcggactgaaggaatggctggatgacgaagaggctctgaaagaattcatgacgatcaagttcaagaacaaagagcgtcttgcagcttacatcaaagagcacaacggtgtagaagtagatccaagatcaatcttcgatgtacaggtaaaacgtctgcacgaatacaaacgtcagctgctgaatatcctgcatgtaatgtatctgtataaccagatcaaagagcatccggagatgtccttctatcctaagacatacgtcttcggtgcaaaggcttctgcaggatatatccgtgcaaaagagatcatcaaactgatcaactcagttgcagatgtgatcaacaatgaccgcagcatcaacggcaaactgaaagttgtatttattgaagattatcgcgtatcgaacgcagagctgatctttgcagcagcagatatcagtgagcagatttctactgcttccaaagaagcttccggaacaggtaatatgaagttcatgatgaacggtgcaccgacactcggaacgatggacggagcgaacgtagagatcgtagacgaagttggaatcgacaatgcatttatcttcggactgagtgcagacgaagttatcaactacgagcagaacggtggatacaatccatacgatatctacaacaacgatccggatatcagaagagtggtagaccagctggtagacggaacttatgcaaacggtgataaagagatgtatcgtgacctttacaacagccttctgaacaatcagggtggtgcaagagcagatatgtactttatcttaaaagacttccgttcttatgcagatgcacaggcccgtgcaatggaagcttacaaagacacagacaaatgggctaagatggctcttaagaataccgcttgctgcggtaagttctcggcagatagaacgattcaggaatatgtagatgatatctggcatctggatcatgttgtgatcaatgaggatgaactggaatattaaaaaaaaccctctcataccttaaggtatgggagggcttttttgtgccagtggggacggggaaagtggctctgccagtgtcaatggggacggagaaagtggctctgccgtcggggaggtgtgcaatatatgagacgatacaggataataagtgaaaaagtgaaacaggccggctgttggctgcttatcatagttctgcttccgtatatcataaccgtatttttaaacggaccgaaggttatcactgcttccaaagcagatgaaacgatggtgaaaataaagaaaaacggaaagatgcctgtagaggagtattgtatcggagtactggccagggatatgccggcagattatgagaaagaagcgctgaacgcacaggcagtgctcatccggacagaagtataccgcatgattcaggaagccggtggagacggtacactgccggaagaagcggcagacgaattctggacagaaaaacagatgaaatccgcatggggtatgcggtatgcggaaaattaccggaagttaaaaaacgcactgaaatctactgcgggacaagtgctgttctatggaaaagatctggcaatgacaccattttttaatctgagtaacggatatacaagggatgcaaaagaggtgcttggaaaggaagagtacccttatctgaaaatcgtggaatgccccagggatgtaaatgctgagaatgagatacagacggtgatactggaagtgaagagtgaacaaaaaggcgaaaatgaggaaactacaggtattgaaacgatggatgtggagatacaggagacggattctgtgggatatgtattgaagatccgcgtgggagacaaggtaatgagcggggaagaattcagaaataaatatcatctggcttccagttgttttacgctgcagccttataatggaaagttaagagtaaccacaagaggagccggtcacggaatcggtatgagtcagtacacggcaaatgagatggcaaaaaagaaacaaggatatagaaaaatattaaaatatttttttaaaggaacggatataaaagaagtgacagaaattataaaaaatgtataactacatcacgatctggcaaaaatatggtcagaggtggtgatgaaatgaagaaaaacgaaaaaacatctatgtccaaacggcgtgctaccgtggcagcagtgttatgttttgtggcagcaattgcaatagcaggaacatatacatttaacgattacaggaaaacgcagaaaaatgagctggcgaaggcggaagaaaaaagcaggcaggaagagacaaagaaagacaacaaagagaacagcgatctgacaagagaaaccggaacatcaaaagtaaaaagtgagaataccggaagcagtacaaagaaaagcgcagcagatgagagtaccgttgatgagaaaaacgaatcagacggaaccggaatgacagatcagtccgaacagaatggaacgggaacccaggcaacagcaggaaagagtcataatattaattttacagaagacagctacattctatggccggtgaacggggctgtgatcatgagctacagcatggataagacggtatatttccagacactggatcagtataagtataatccggccgtgatcatcgaaggtgcagagggagaccaggtgctctgcggcgcacccgggatcatcaagtcgatcgatgtcagtgcacagacgggaacaacggtcaatgtagacatcggaaacggatacgagctgttatacggacagctgaaagaagtacctgtgaaggtcggggactatgtagaagcgaagagtgtgcttggttatgtgagccagccgacgaagtattacagcaaagaaggctgtaatgtatattttgagatgcgcaaaaatgggcagccggtgaatccggtggagtatacggcggatcaggattaaaagaaaaggacagggatttccagaaatctctgtccttttcttgtgcggtccttctttttgaggggtggataaaattgactttccgcaggataacagataaaataaagtggattattacaggaaaaatcagaccgattgtggataagtggggacaactacatgaattatacctatatcataaaatgtgcagacagtacgttatacacaggatggacaaatgatctggataagaggataaaagcacacaacagtggaaaaggtgcaaaatacacgaagaccagaagaccggtgaagcttgtgtattacgaagaacatgagacgaagaatgaggcaatgagccgggaatatgcgatcaaacagttgacacggagagaaaaggaactgctgatccaaggaaaaggaaacttatgtgaaaaagagtgtggataaggagatcgagatcggagagaagatcccgaatgaatttgaactcgcagaataagtaaaaataaatgatattaagtaaaaaaagctgccaccggcagcttttttcatatggctttcattaaagtacaaaagcatacatcaccacaaagtggcatgcgcttccggccatcacaaacagatgaaagatctcatggcttccgaaatatttgtgcttactgttaaagatcggaagcttcaaagcatagatcacgccgccaacggtgtagatgataccaccggccagcagccatacgaaagccgccggacttaaagaattcagcaattgtgtaaatgccagtacgcaggtccagcccatgccgatataaagcacggaggaaacccatttcggacagtatacccagaatgctttgatcaggattccggcgatggcaaatgaccatacgatcgcaagaaggatgatcccggtcctgccgccaagtactaacaggcagatcggagtgtagcttccggcgatgagaacgctgatcatcatgtgatcgatctttttaagaatggtatttactttttttgatttatcgaatgtatggtaagttgtgcttgccgcatacagtaagatcagacttgccgcatacacagcaattgcgataatgtaaatcttacttggttcgcgcgctgcttttaaaagcaatgggattgctgcgaatattgccatcagcattccgataaaatgtgtgatcgcacttcccggatctttaatgtgttcttttaactgctctgccatagtcatgcacctcctgaatgtcgaaaatatgacatgtagtttttaatactatgtttgctatatgtgtatattataccaggaaaagaaaaaaatcaagcagaaaaggaaaatatttttaaaatcaaaataatccttttccgcttgattttttacatatcaggttctaatttattttcattgcgccagcttcttggagaagttccataggtattcttgaatgctcttgaaaaatgtaactgatttggatatccgacggcatttccgatatctgcaatggataaagaggtcagtttcagaagttctgcagccttcgtcatgcgataactgatcaggaattcctgaggagattttccgatggagtcgtgaaaaatctttccgaaataactccggttcagaccacagaaagaagcaatgtcttcaatggtaatattgttctgaaaattttgctcaatataagataatgcttctttgatgtaaaaatctctgatcttcccgctctggttcatgcgcactgtagcagcagaacgcatgaaataatccaaaaagagatacaaatgtccgattatatggaacggtgaatcggaggaggaaccggaatgtctggcaatatataacatttcgttcatcatttcattgcggagatctttcgaaccggcatgatagaccggatgatccggactgagtccggcagtagagacaatctctttggcacggagtccgtcaaattcaatccaggtatattcccatgggagatcctgatctgcgatgtaagtattgatctgattaggaaatagcataaaaccctgtccgcttttcacctgatattttattgtattgccggaagaatcatcggccattaaagttccggttccggatatcacatagtgaaagatataatggtttctggcggcaggtccaaaagaatgggaaggttcacattgttcccagccatactgataaagtccgatatcaacaaaattttcatttgggaaaacggaaaataaaagattactcataggaatcctcctttttaaaacagtatataccaaaatgctagatgacttcaatatataacgggaaaaatcgcattttgcaataaaacatataatataatgatatttatagacgcataagggtatgttacaattcaattgtaaataaaaaataaaaaaacctgacgatgaaaacaagaaaatatcccgggaaaggttcaaaatcaggaaggaacggaacaaaaggagtttgaaaaacatgcataggaagtacaggaaactggtaagtgccggactggttcttacgatggctggggctatgacgctgcagggatgcgggcagaaggagaagacaggaaagacagaaatagaacttgtgcagtataagccggaagcagtaaaaacatttgagaaaatagaagaagaattcaaccgtacacatgatgatattcatcttacaattgaatctccgaatgatgcaatgactgttttgaagacgagatttatccgggaggataatccggatattattggaatcggaggagacgtgaactattcaaactttatcgattctgacatgttgatggatatttccgactataagggtctggaagatattaaagaggcatacaaagaaattgataaaaatctggaatttgttccggaaaaaggaacttatgcggtaccatatgttgcaaatgcagcaggaattctttacaacaaggaaatgttcgaagaacatggatggaaaataccaactacatgggatgaactcatgagcctgtgtcaggagatacagaatgcaggaatccagccattttattttggatttaaagatacatggacttgtcttgcaccgtggaatgcggttgcggtagatcttgcacccgcagatgtgtgtgcacaggtgaaccgtggaaagacaacattttcgaaggaatataaagaagtggcagaacgtatgctggagctgcttccatatggaccggatgacccgtttgcatatgattacaacggggcgtgtacggcatttgcaaaaggtgagtccgcaatgtatacgatcggaagttatgcaattccacagatccagacggtgaatccggatatggagattgattcatttgtaatgccggcaagtaataacaaggaagaaaataagttgaactcaggaatagatcttcagttctgcgtaatgcaagactgcaaaaataaagaggcagcatatgaagtgttagattttctcctggaagatgagaatgtacaggcatatctggatgcgcagaaggcggttccttgtaaagaaggagattttgaactgccatcaacccttgaaggaatgaaagaatatataaaagaaggaaaaatgtctgactatcaggatcattattatccatcggaaatggcggtagacgcacagatccagacattcctgatgaaaaaagacagcaaggcatttcttaagaaatttgatacagactgggtaagatataatcgtgatattatccgtaaagtggaagattacgagaaatcgcataatgactaagacagataagttactggtaatacggaagttcaaggagttagtacgatgaaaaagaataaattaaatgatagaaagcggacatttcttctgatcacgattccgattgttgcattatttttctgcttcaatacgctgccgctgatcaaaggtgtcatctatagttttaccaattttaaaggatacggaagttacgactgggtaggtcttcgtaattataaagatctgtttaccgattccagagtcggaggctcatatatctttacatttaagttggcaattgcggcgacaattttgacaaatgtattgagtcttctgatggcactcggactaaatagtaagatcaagttcaaaagcgcactcaggggtgcatattttatcccgaatgtactgggagcactggtggtaggatacattttcaactatttctttacgtatatcctccctgtatttggaaaaatgatcggaagtaagacatttagttccagtatgctttctaatacaaatcttgcgtggatcgcgattgtgatcgtgtgtgcatggcagtcgatagcaatgaacacaatcatatatatttcaggacttcagacggttccggaggatgtatatgaagcaggtgccattgatggtgctacaggatggaagaaattcaggaacctgacatttccactgatcattccatttttctctatcaatatggttctgagtgtgaaaaacttcctgatggtatttgatcagatcatggcattgacaaaaggaggtcctgcccagagtacagaatccatctcatatctgatctataataacggaatgagtggtggacagtttggattccaaagcgcaaatgcagttattttctttattgtgattgtagtgatttcggtaatgcagttgactatcaccggtaagaaggaggaacagttgtaatgaaaaaagttgggaaagaaagaataaactggcctgtaacgattcttttgatcgcagggctgatcactgtagtatttccattgtatatgactgttgtcattgcgctgaagaaaccttcggaaatgacgaatgatgtcgcaggaatcttatcgcttccaaagcatttcagtctgagtaattttacagaggcgatgaaagtgacagatttctggaactcattgggaaacagtctgctgatcacagttgtgacggtagtgcttgcaatgctgatccattcactgcttggatatgcaattgcaagaaataaggcacatagtaaattttataagtttatttatttttatgttgtcagtggtatgttcgtaccttttgcaatcctgatgatgccggtcgtaaaacagacggcgcagatgggacttgcgaacagagccggagtgatcatcttatatctggtattttatatgccgatgaatgtgctgctgtattccggatatctgacaaacattcccggagcgctggaagaggcagcatgcgtggatggagcaagtacatggacaacttattggaagatcatctttccgatcatgaaaccaatgcatgcaacggttgcggttctgacagcacttggaacgtggaacgatgttatgacaccattggttattatgtcaggcacaggaaagaacacactgccgctggcacagcttaatttccagacacagtttggaacgaactataacctggcatttgcctcttacctgttggcacttctgccgatcctgatcttctatctgatctgtcagaagcatatcttgaacggtgtggtaaatggagctgtaaaataagaaaatacaaatcggataaaagacacaaaaaggagactggaaaatgggaattgtttacagtaaatcagacaggacatttacaatacagacaaagaatacaacgtatcagatgcaggtggacccttatgggttcctcctgcacctgtattatggaaagaaaacagatggaagctgcatggattatctgctgacgtattatgacaggggattctctggaaatccgtttgatgcaggggatgacagaacatattctatggatgcacttccgcaggagtatccttcctatggaaccggagattacagaagcacggcactgatcgttgaaaatgcagatggaagtacagcgtgtgatctgcgttaccgttcgcatcacattttcaatggaaaatataagattccgggtcttccggcagtctatgcggatgagacggagagccagacactggagatcgtaatggaagatgcggttacaggcgtagaagttacattgcagtatggtgtgcttcctgattatgatgtgatcacaagaagtgagaagatcgtttatcgcagcgaaggaaagatatgtatcaggaaagcgcagtctgcatgtctggattttgttcaggggaaatatgatcttctgacattttacggaagacatgcaatggagagaacgatgcagagagagccggtcacacatggaagtcatgtgatcggaagtgtgagaggaacttcgagccatcagtataatccgatgatgattcttgcggatgagaatacgacggatcaatatggaaattgttatgcaatgtctttcgtatatagtggaaattttaaaggtgagacactgaaagatcagtttggacagacacgtgcgcttatggggctgcaggatgagatgttctcgtatccgctggcagaaggagaaacattctatacaccggaggtacttcttactttttccggaagtggaatgaaccttctttcacagaatctgcacagatgtatcagacagcatatctgcagaggaaagtacaaagaaagtgtccgtccggttctggtgaacagttgggaagcatcttactttgattttgatggtgataccttatacgaactggcaaaagaggcaaagcatgcaggcattgacatgctggtgctggatgacggctggtttggaaaacgtgatgatgataacagcggtctcggggactggtttgtcaatgagaaaaagcttggggggacactgggagatctgataaagaagattaatgatctgggtgtaaaattcggaatctgggtggagccggagatgatctcggaagacagtgatctgtacagagaacatccggactgggcacttactattccgggaaggaatccggttcatgcaagaaatcaactggtgttggatttctcgagaaaagaggttgtagatcatatatttgatcagatctgtaaagtcctggatcagggaaatattgagtatgtgaaatgggatatgaaccggagccttatggatgtgttctcgagaggaaccgaagatcagggaagggtcatgtatgattacgttcttggattatatgattttctggaaaggatcgtgacaagatatccggatctgctgatcgaaggatgcagcggcggcggtggaagatttgatgccggaatgatgtattatacaccgcagatctggtgcagtgataatacagatgcattggacagattgcagatccaatatggcacttcattcggttatccggtatccgctgtagggtcacacgtatcagcagtgccgaatcatcagacaggaaggatcacatctctgcataccagaggtgtagtggcaatggccggaacattcggatatgaattgaatcttggaaaactttcagaagaagagaagcaggagatccggttacaggtggaagaataccggaagttcgcaccactgatccagacgggactgtactaccggctgtctgatcctgcgagggaggaatatgcagcatgggcatttgtatccgaagatcagaaagaagttcttctgaacgtcgtactgcaggaaattcatggaaatatgactgtgaattatgtaaagcttcaaggattgaaatgtagtgcgatctatcgtgacacggaaacaggaaaaatatataatggtgcagcacttatggaagcaggaattccgatgcctgtggaaatgggagaattcaaggcataccagatgcatctggcagtagaagagtagagtataaaaatgggaaaaagagtagaaaaaataacagtatttttcaatataggttagagaaacatcatgatgagctcagatggctttacatggaactttatcagaatgatgatatgttcgcggaattgtgttccaagatgtatgagtattacagacaccggagtagcaaactgaaagaatgcaacattaattgtcttcatcttatgcctttcctggatacgccggaaggcagatctgacggcggttatgcggtggcagattttcgtaagatacgcccggatctcggtacggtgaaggatcttgcagaactggcagaaaagtgtcatgaggaagatatcaatgtgtgtatggagcatgatgacagtgtcctttgcatattacgtgaatataagggaagaagattttttggaatattcaacttcagtgatcaggagaagacagcgtggatgcaggaagatggagtatatcgtaatctgctgacgagtgaaaagatggaattaaaagatataagattaagagggtacgacttcctttggtgtgaaaaataaactggcctgtatggaaatgttacaactggctgtttggacgaatccactatcgtgctaatatattcagcagaatttatttttcattacatattacaacaggaaggaagagtacaatgagtacaaatacagcagcaggaaagaccattcataatgataaggtaaagaatctggtgatcacggcattctttacagcaattacatttcttggaatccagtctttcaggattccgcttccggcagcagtcggaacaccatttcttcatttcggacatatatttgtcgtaatgggattgttacttcagggaggaaaaagaggagccgtatccggaacgctaggacttaccatctttgatatgttaaatggatatatgcaggatgcgccaaagacgtttgttgagacggcgctgaagtgtctgatcgtcggagcactctttgtgatgctgaagaaaaagacagccggtgataaaaagaaagaatacggagcagcgatgatctgtgccgtggtttacggatgcatcaacgtaatcatggaatttattatgggaaccatatctatgatgatcatgggaagtggattcgcagcggctgcggtgggagcatttacatctcttccggctacggtgatcaatgcagtctttatggtgatcgcaattgcggttctgtaccagccggtgaaaaagatctatgtgcgcatggcatagagcaggatagtggaaaaaataatgaatgaacaaaaaagagcggatactccttaagtggtgtatccgcttttcttctgatatcagaatccgttatgcttatccgaaatatctcttgagaagtccttcgaaagctcttccgtgacgggcctcatctttagccatctcatgaacagtgtcatggatcgcatccagatcagcagcttttgcacgttttgcaagatcgaacttaccggctgtagctccgttctcggcatctacacgcatctcaaggttcttctttgtgctgtctgtaacaacttcgccaagaagctctgcgaatttagcagcgtgctcagcttcttcccaggcagctttttcgtagtataatcctacttcaggataaccttctctgtgagcaactcttgccattgcaagatacataccaacttctgaacattctccttcgaagttcgctcttaaatcagctaagatatcttcgctgacaccttttgcaacacctacaacatgctctgcagcccattctctttcacctgtctgttctttgaacttatcagccggtgcgtggcagattggacattcagccggtgcagcctctccttcgtaaacatatccgcatactgtacatacaaattttttcataatgttgttctccttttctttgaattgttttttttgatttattgaaattaatattagtaattgttactgatattaatttagcacgatatcattgttttgtcaattagtttttgatgaattttattatttattctcgtttttttcctttatgcattcggcacaaagaccatggaaaagtgtagtgtgagattcgatgattccatcaaaacatgcgttagcatcttcgttgatcttttgaatataagaatcatccatttccagatcgaatacttttccgcaattcgtgcatactacatggtaatgaggttcgcagcgcccatcaaaacgatcgccaccggcaggtgtcggaatccggagtgcttcaccgatgtcggcaagcagattcaggttgcggtagacggttccgaggctgatattcggaaattcttcttttatatgaagatatacggtatcagccgtaggatgtgcggttgtgtgtaataaatactctttgatagaggctcgctgtttactgtattttaaagcagccataacatccccctttcaataacgataataattactatgattgatatctttagtatagtgctgttgatatcatttgtcaataaggataaataaatgtaacaaaatgtaacaaaataaaagaaaaagacgaatgggaaacagggggacgacatatgatatgcttgaaaataaaagaaatacttgacaaagcgtatggggatgatataataacaaacgtaacatatgtaacaattctgtaacaattacaaaagacgagaaaacataaaggagggagtttatggattcgattcttaaaaaaggagtgctcctggttagtctaaccgggatcatgacagcatttccaatggcggtgcatgctgcagacatagatgatacgcagaatataccggcggcgggaaacacgcagatactggaagattgttacacatcagataagacaataccggtaaatgatcatcttgtaccggaacaaaagggtgagtattcagatatggcattcgcaaatgtacaatcgtttctttatataagaagtgaaccaacaacagacagcgaatgggttggaaaactatatccggattatgcggcaaagatcaccggtcctgtgggagaatggacgaaggttgagtcgggaaatgtgaccgggtatgtgtattccagatatataacggtaggaaatgaggcacagaagaaagcagaagagttagtgcagaacaatgacacgggaaatgtagaagatgcatttacgtatgccgaatcgagagaagaagaggcggcaagacttcaaaaggagcaggaggagcagaaggcgcaggctgcgggaaacgggcaggcaattgtagattatgcgtgtcagtttatcggaaatccgtatgtatggggaggtacgagcctcacaaacggagcggattgttccggattcgtacagtcggtatttgcacattttggaatcgcacttccgcgtacgacatgggatatggagaatgcgggaacggcggtaagttacgatcaggcagttgcgggagacattatcttatataatggccatgtaggaatctatatgggaaatgggcagatcgtaaatgcgatcaacagtgcaaaaggaatcgggatcctgccggcaacctatacgaatattgtgaccgtaagacggctgatataagagttgatataagaaaagagaccggaggaattctgaaaaattccccggttctttttttatccacactatccacatgaattgaaagttatccacaatatacaaaatccacaaaaatcgatatatttctgcaaaaaataaaaaatacaaaaaaattcatgaaaaaagttatccacatcaaaaaatgcaaaaaatgtagaaaaatggggattttcacaaagttatccacgttatccacacccaaatcgggaaaaacgggggattattcggggatagaaaaagaacgcacgttttgtagagttgttataaaaatgaagaaatgtcgaaaaaaagagttatccatattgacatttgagtagtcaaatattaagaataaatttgcggaaaatgtttacacaatggtaaaaagctactataatggaaacactgaaataaaaaggaggcgataagatggcacagattacaaaagacatgacatttggtgaactgctttccaaatattattctacatgtccaaagcttgttgacgatctgatggaagcaggaatgggatgcatcggatgcccacattctcagatggaatctatcgaagaaggcgctatgggacacggaattgatccagacctcttagttgcaaaactgaatgcaacactggaagcaagccaggcataatataaaaataactataaaaaaactctacaggattcctgtagagtttttttgcagttatttgtaaagaactgccgatagcagagctttatgacaattccggatcataattccggctaaatattggcgagctgctgaaccgcatctccggaaagaaatgtcttgcagtgttcttccaggaacgcgaaagttgcgccggacgctctttctaaagcgccgtattcagacaacatattgcagatccgattgaaatctgcggcggagtgatcggaccgggcaagtgccagtagatacatctcctcttgttcgtccttgtataaagtattggaaccgtggtacatcggagccagaagtctggcggcttttagtacattctccatcacagggaaagaaaagagccggatattgttaccggaatcctttttttctgtatcatcaccggaagcggatgtggtatccggggcagacttcgctgcctgtgcttcaaatgattcctgaacctttccgagcagatcgagtaaaccttctgctccttccagcttgcccggagtattctttttcctggcatcagcaatggaagaaggtgcaaattttgaaaatctggtatcgagttcctcaggatcctcgacttttgtaattatcagcacgatcgaatcggcggaagggattgcctctatcatgagaggaatgtcttctgcttcgaatccgaattcgaaggctgcctgttgcatcatatcgcggaaaagtgattttgctttttcggttccgtatgccagttcactgagctgtaactgacggtcagccagatcggcgcgtgtcaaagtacaacggatctggttgtcactgattttttcaatcttcataatcatcacttccttctaaaatagtatatcatagaaaatgtttgatgttcaataaatttagtataaacaaaacggaataataaaataaaaaaagacttgattcttcaaattttatcagatataatgacgctactggaagatagttttccctgataactatgttgttagaaccaataagggagaattttttgaattttaattttggggacggaacagaacgccgtaccaggcatttatatttcaattccacgttccgggtgggatggatctatcaaaagcaaatcagattacacagccgtttcaggcagatatttcacagtataattttgacataatatgaaaaatatttaattgccggggactatttccagttgaaacataatttgttgctgcgtaaaaacagcattgtatcacgggcatctccttcgctgcagatatgcgcaacattcatagttatcatccggtaaaaaggaggaaggaacatgggggacaatgacgaatggaagaatatgttccaggaactgacaggctatgaaaagaaaaatataagcctcaggatcaatggaataccagccagccccatgcagattgtacaggcacatacgatgtgtgaaaatcaggcatatatgagagattatgtgctcaatgacaaaggtgatgtaaaagagttgtggtttcagaatatagcaatttaatcaggaaaaatatgtaaataccccgcagattaagacgaaagttttaaggaaaatgtcgaaatataatgacgtgtatcttacgttttgttataatgtgacctgtaggaggtgcagcatggaagacagaggaagaagtagccgcacatatgaaaaccgaagaacatatggaaaatcacagagaagaagaccgtcagacaatcatccgccaaaaagacagagaactccggcggagcgtgcgcgtatgcggcggagaagaaaaagacaacgcatgatacggtttgtcctgttgatcatattaatcattgcagcaattgcaggaatcattttgtggaaacgttacagcccatcaaaagaacaatatgatatgaagaaatattatgggatagaaaaggatggacaggttggtatcacggtggataataaagtcgtggaggcagaaggaaaactggcaggtggaaaagtatatgttgcgtataatattgtaagagattatatcaacagccggttctactgggatccgaatgaaaatgttctgttgtatatgctcccggaagatatgatatcggtagatgtcggcagtaaggattactctatatccagaaaaaagaaaagcgaagattacgttattttaaaaacagaaggaaacacagcatatattgcattggattttgtccagcagtacacgaatattgattatgaagtgtcaaataatccggatcatgttatgatcaggacaaaatggggaaaaacggatgttgcaactgtgaaaaagaatacacaggtgcgttatcagggcggagtaaagagcccggtgctggcagaacttaagaaaaaagatgaagtaacagtcgttgagagtgaacagaactggaaaaaagtacgcacagcagatggtgtgatcggatatgtaaagaacaaagctctgaagaacgaagaaaagaagaatattaccagaaagtttgaagagcaggattattccaatatcagcaaagattacacgatcaatatggcatggcataatgtgacgaaccaggatgcgaacaatgcggtggcgcagaggatcgcccagacgaaagggcttacgacactggctccgacatggatccatgtggcagatacgaacggtaacatcagctctatcgcatcggcagattatgtgagttacgcacataagcagaatgtggaagtgtggatgaccgtcagggattttgacggaggcatcagttcggagaaggaatcttacgaactgctcagctatacatccagacgtgagacattgatcacgcagctgattgcagaggcactccgtgtcggcgttgatggtatcaatgtagacttcgaaaagatttccgataagtgcggagaacattatattgaatttatccgtgaattatcggtaaaatgcagacagaacggactggtgttgtcggtggacaactatgttccaaagagctttaacacacagtatgaccgtaaagagcagggaattgtagcagattatgtagtgatcatgggatatgatgagtattatgcaggttcgcctgaagcaggtccggtatcttcttacaattatgtaaaagaaggaatcacagagacgttaaaagaggttccggcggagaaggttatcagcggtattccgttctttacacgtctgtggaaagagactccgaagacggaagaagaactgaagagtgataaaggaacggatgcggaacagtattctgcaaccgtagagagtgatgcatatggtatggataatgcacaggccgtcgtcaaacaggccggagtcgatacgacctgggataagaaggccggacagaactatgccacatgggaagcagacggatccaaatatgagatctggctggaagacagcaaatcaatcgaagcaaagctcaaactcatgaagaaatataagcttgcaggtacagctgagtggtctcttggacaggagagttcggatatctggaatctgatccagaaatatgtcaattaatcaaacagaataacagataaaatatctcttgcagtcatatagtagaatatatgaattgtaggaggtatttttatttgtggaaaaaaatagaatttgcaatagtattgctgctgctggcggtacttatcatgatgagtaatcatctggaggaaatggtatcaagcggaagggttacaggaaggaatccatgtattgtcctggacagcggacacggaggagaggatccaggaaagattggtgtgaatcaggcaaaagaaaaggatgtaaatctgaaaattgcaaaaaagacaaaagagagactggagaaaaagggatggaaggtcgtcatgacaagagaaaaggatgtaatgcttggagatccggctgcaggaaataaaaaaatccatgatatgaaagcgagagtggaacggatcaataagacgatgccgcaggctgcggtcagtatccaccagaacagctatcaggatgcgcagatccacggggcgcaggtcttctattattcacattcggaagagggaaagcgaatggccgaagtgatgcagaaagcactgctgaaggcagatgaagagaataccagacaggcaaaagcgaatgatacctattatcttctgaaacggacggaagtaccgacgatcatagtggagtgcggattcttaagtaacccggaagaagccgcaaagctggtcagtccaaagtatcaggagaagcttgcggaagcgatcgcagaaggaatccttgcttgtatggaaaactagagtgtagtataataacaatcatgaaaacaatattagaaaaaattgataaaaatcaaaataatacagatattataagagaagcaggacggatcttaaaagaaggaggtctggttgcatttcccacagagaccgtatatggtctgggagcagatgcattgaatgaagatgcggccaagaagatatatgccgcaaaaggaagaccgtctgacaaccctttgatcattcatatcacgaatatgaaagcactggaaaaaattgtttccgaagtcccggaaaaggctgtaaaggttgctgaaaaatactggccggggccgcttacaatgatatttaacaaaagtgatattgtgccgtacggaaccaccggagggctggatacggtagctgtccggatgccggtagatgagatcgcaagagaagtgattgatgcgggcggcggatacattgcggcaccgagcgcgaatacttccggacggccgagtccgacaaccgcacagcatgtagcagaggatcttaccggaagggtagacatgatcgtagacggcggggcagtagagatcggggtagaatctacaatactggatatgacggtagaaccaccgatgatcttaagaccgggagccattacaaaagagatgttcgaggaagtgatcggagaagtcacgatcgacaggacgctgatcagaccggacagcaggcaggttccgaaagcaccgggaatgaagtatcgtcattatgcaccgaaagcggatctgaccattatagaaggtccactggagaaggtgacggcagagatcaataagcgtgcaaaagaaaagtcctgtgcaggatataaagtcggcattatcggaacggaagagactgtggcagaatataaggccggtgacgtaaaatgcatcggaaccagagcggatgaatcaaccatcgccgcaaatctgttcgggatcttaagagagtttgatgacgatcaggtagattatatctacagtgagtcgtttgatactgcaggaatcggaagtgcaattatgaaccgtcttctgaaagctgcaggacatcatatagaaaaattggtatagaatcatttcacaacaaggaggagaaacatgtcaaaagtacaggttatggatcacccgttgattcagcacaagatcagctacatcagaagcgaagaggtagggtcaaaagaattcagagagatcgttggggagatcgcatcattaatgtgttatgaagcaacaagagatctgaaactggaggatgtcaggataaagacaccaatctgcgagatggtgggaaaacaattaagcggtaaaaagttagcagtagtgccgatcttaagagccggacttggaatggttgacggaatgctgaatatgatcccgtctgccaaggtcggacatatcggtctttacagagatccggagacatatgaaccggtagaatattactgcaaacttccgtcagactgtgacgaaagagaagtatttgtcgtagatccgatgcttgcaacaggcgggtcctgtgtggcagcacttcagatgctgaaagataaaggtgtaaaacatatgcgttttatgtgtatcattgcagctccggaaggtgtaaaacgtctgcaggaagcgcatccggatgtagatatctatatcggtgcactcgatgaccatctgaatgagcataaatatattgttccgggactgggagatgcaggagaccgtatttttgggacaaaatagtggcgaggtgacgtatatgggagataaaagaacagattatatcagctgggatgagtattttatgggtgttgcaaagctttccggaatgcgttccaaagatccgaatacacaggtaggatgctgtatcgtcagtcaggataacaagatcctgtcaatgggatataacggacttccgacagggtgctcggatgatgtatttccatgggcgcgggaaggagaagatcctttagagacaaaatatgtatacacggttcacagtgagctaaatgcgatcctgaattaccgtggaggaagtctggaaggggcaaaattgtatgtctcgctgttcccgtgtaacgaatgtgcgaaagcgatcatacaaagcgggatcaaagaggttatctatgacagcaacaagtatgaaggtacagcagctgtaatggcttccatgaagatgttcgattctgccggcgtgaattatcataaataccatcggacagaacgggaaatcaagatttcgttataaaataaaaagcagattagagatcatgagacaggtttgaaaaaagaaaaagttttcaagcctgtttttttagatgctttttgataattatgaaaggtataagacagatacagatcatcatataataaaaaaacagagtaataaaaaagagaaaaatatgaaaaaaaagggaacaaaaatcattgtaaattttctgattcgtggaattattgggttcgcaatcatattttttgtaaacgaatttcttgacggacagggaatttctgcttgtgtcgggatgaatccgatcacttttttgacatccggatcctttggatttcctggggttgctctactttacggtataactttttatcaaattatgtaaacattgcacaaagattgaaaacttttaaaaagggcatagacaaatacaaatcatccagtatataatcagcctacaagttacgaagtagcttgcatctgatttgtagttctaattgttagattcaaaaaattcaagaagtattcaatgccgtatcggcaaacgtttcagattttgtgtaaacgtgttgaaggagggatagtatgtggtaagcagaaatctggtgatttgtgaccaggaagtgagatacgctgcggcccttgcggaagtttttatgaaagcgaaggagctggcacttggcgtacaggtatgtaacagtgttgagcagaccgtaaaactgcaggaggaatcaccggttgatatcctgttgatcggaagcagttatccggtagaagacaggaagaagataaaggccgggaatgtgttcgttctggcacagtcggaaaatgcagcacatgagacaaatgagaaacttatcaataagtaccagtccggagaggccattatgggggcagtgatcgaacagtgtacgcagtccggggaaccggaaagatttttccttaggacagcgaaaaagcagaatgtcaggatcatcggaatcttttccccggtgcaccggagtaagaagaccgggtatgcattaaagctgggaaaagaattggcaaggacgtacaatgtattgtacctgaatcttgaagtatatggagggatcgggggacattttccggatgccggacagacggtagcggatgcactttattattccagacaggagaagaaacacttaagagcagctctggcaggtatggtaaaacatatgggaccgcttgactatcttctgcctatgcggatgtcggaagatctgaaggcagtggagatcgaagagtggacagggtttgtggaacagattgcagaacagagcatatatgaagtcctgatactggatatcgatgaagggatccgtggagtatatgagctcttgaggatgtgtacggagatacatgtggcagtcataaaagaggaggtggcgcaggcaaaattattccagtttgaagaagaattacatctgatgggttatgacgatgtaaagcagaagatggtaaagaaagagctggaaggatgaggaaaatgatagaagcagagcagctccatgcaaggatattatccagactggatatgacaagggacatggaggacgaagaactgacagagttgatctatgaagtacttcaggaagcttcgcaggaagaatatctgccgttggatcagaaaacaatgcttggaaaggaacttttcaatgcattccggaaactggatctgctgcaggaatttctggaagacgaacagatcacagaaatcatgatcaacgggacgcagaatatatttattgaaaaagcaggaaggatcatccagtcagacaaaagattcttatccagagacaaactggaggatgtgatccagcagatcgtggcaggatccaacagactggtaaatgaggcatcgccgattgcagatgccagactggcagacggatcgagagtcaatgtcgtacttccgccggtcgcattaaatgggccgatcgttacaattcgaaaatttgcaaaagaagcaattacaatgaaaaaactgatggaatggcagtcaatcaattcagaagtatcaggttttctggctttattagtagccgccggatacaatatattcatcagtggtggaaccggatccgggaaaaccactttcttgaatgcactatcgcaatatatacccaaaaatgaacgcatcataacgatcgaagacaacgcagaacttcagattcaaaatgtaaagaatctggtaagactggaagcaagaaatgcaaatgtagaaggaacaggagaagttaccatcagggatctgatcaagtcggcacttcgtatgagaccggacaggatcatcgtgggggaagtgcgctcggcggaagcaattgatatgcttcaggcacttatatgtactatataataattatatatataacgtatataaggatggaaaatatagattagagggaggggcataggaacgatatgaacattaagtataggttattgtgtaaaaggttaatagaggaaaggaagagagtaggtgtcattcaatattataatgtactgttcataatggagttagtgtcagataaagacatatgggctttagaacagtggatgaatggtataaataacatatatatgaaagatatacataattggtgtagaatacattttgttaaatatcacactgtatttgtttacaggaaagagtatccggtaaaagcaaatatttggaatgggtattcatatataaggtggcggatggagcggttgatgaatttgggataagataaaatagtgattgcatgaaagagagccttaaagcagggtgttcttttgaaagtatggatagaattaaaggctgaaggctctgcgctattcgtttggcagagcctgagtattctcttgatccgtagaaaataaatctaactgcccttctggagtggaactttgaccggattcatcttcagttgatggttctctttttttgggtgttttatgagtgtataatttctcaaaaggaagtgaatacttggattttttattgtattctagtaaaagagcttctgcgaatcctaatgaaccggcacgacgttctctggcagtacgactgatttctctgacagagacacgcccaactttttctttgaaggtgtcatctttcattgtttctccataagcattatccagacgggcaatagcattaagcatattggaactaaaggacataggcgcaccttcccatgtggcaacacaaaggcgtaaaacacgatcaagagtgtgaaaaccatatttttcatagatattaattaaagtggatacagcacatatacctccggggcgagaggaagaagtaatagtgagatcatatgattcaacaaggtcacgaataataagttctctatcattaccagcttcaatattagccatgaatatttcataaggtaataacgatttgacatatttcatctgatttgcaaaaatatctgcttcttgggtgtaaacaagatcatcataaaccatacaccagacaggagtttctcttgatccagagacgagagcaacaatctctatagtgtgttgtccgttgaacacataatttatcccatcacgtctacttacttttacagggtttatctgataaaggtcaaaattagctgcagcacgctgaacgtgtttgatggaaagattacgttgataatcttgatttgaacataaatttttaataggtatttgctcaaaatgcacttggggaacaaacttttgtaaatcttcggtatttccatccataattatatttcctccaatttttttaaaatattatttgtggttgatattagacacataagctgatatttaagcttatattttgctgtatcagatgcaattttaaaatctgaaacttttaatactctttcgatagaactgttccacgagggaatcgtcaatgtaagacttgcaatttccgcatctggatcaaattgtggcaggttgcgtattgaaggaatagaaacggaagattctttccttaacatcggtttggcgtaattattccatagtaattcccttttcatatcatgataactgagatgttctatcttttcggcaagaaggtagttatttagacttaaaagttgctcttttggtaatcctgaaagctcaataatattagcttgggaaatccagagttgaccagaacgaactcgtttgacaaaatccggaactttttcatcaattatatctagtgcactactgtaagcagaatatttgtaaacggtagccattgctacattacattcttcggatattttttttgctgcgatgcttgcaccggaaatatgagatttattcgtagatgaaagttgtcttgaaactataattttttcagcatcatattttttcccaatcaggtattttttattgatattggttaaatcctctcgtttaagttggtcagtacatatccatgaaattacatcttctttactggaaaaatggagtctttttattcggaaaggaatactgtgtttacgaaataattcatatgcttctataccattaatgacaataccattccatgtgcagatgggggtgtgataggaatgacataatatctgttgttcaagttgtttataatctttttcactgagatattgatacaaattggtgaattctagttttgtttttaatgtatatatactataattgcgcatactcatctcccattatttctgatttgaattctgtttgtggcagttttgtgatgatgttatccatggaaaatagagctatttttttatctgggtaaatattgccttctaaacgaaaaatgttaaatttctcccaagaaaggttaagttgggaaagtgaatatagtaattctcggctgtacaattcataactgttaccattgatgacaaaataatccttaactttatgtgccaatttatcctccgcacaactagcctttatacctatcattttttgatcaggattaacaagaagttgaatatattctgggttaccaatttgacggagtgtattgcggtggattcgtatacgattctttttaaagtcaatacatattagtggatgggaagagtgtttgttgttcataggatttttcctcactttctgctgttgatggttcttttgctttttctatggatttatcagttgccttcttcttttcttgtatgtcaaatactgcgtagccttcaaatatattgacttgcattgatttttgatgttcttccactggaataccgaactgattcttccattcttcaggataagaaggtgtcctagcagtggttacagttccattgtcttttagagtacgaggaaatatttcaggtgaagttaaatcgaaaatgaacagtatttcattgccagaacgaattagtttgccgagaatcttgtaccgataattaggattccagtccatgagagatatcactttagcaaagaaaattcgacaggtgatttgttttggcgaacgcttttttccagaggaacaccaacgaaaagagtctttttcttcttctcgacagggacggacagccagttttttttcaatgggattgactaatatttgcacatattcgacatcgggtagtttttttatgcaggcggtatttacagataccttgtagttattaaacgtaaacgaaggttcgtaaatatgagcgaagaattcgccacgtacaacttgataaccgtcatagctgaaagaatcatcgtcaatgacttccatttgatttgaggggctgggcgcgactgttattggcataggtgtgttgattttcatcatatcagaaggttctgtagtcatattccattgatttataggttgctcgctcattgggtgtctcctttaatttctgtaataatattctttatattttgtataatggtttctttgggagtggtttgtagctcgggttctttataaggtttactttctgaagcagtctgccagtttttgtctgctgtaaattctgttaattctggcgcttgagactgagtatagtaattattaccgaagctattcatccaatcggcaggataagctaacacactcttagaatcagatattgtatcaggcatgttgttattgggggcggatacgtcgttggtacttgtcggtattcgtatttctgtatcgtccatgttgaaaataaggacattttcattgcctttttggtgggcaactcctaatattctatatttgcattttttgtcccatttaaatatctcgtataatgttggcaaaaatgcagcgccggaaattggttttggaataagttgaccatctttgagacgtgaccactgcactttattttttgtttcagaggaacatggtcggatagcaagtagttttgagcttgggtgtattagcagttcgacaaattttatgtttggaaatttccgtatagcatctttgttaaaagagatctgtttatatgaaaaagaaacagaaatccgaccaacagaggagaaaaattgtcctctggcaacttcatagtctcttaaatcgaaggaaccggcggaagcagtaattgtatcaggtacattcatatttgccggtttaaggacgctttgagatgcttcaaagtagtctctagctttaaatccagaccatcttggattaatgcttataaatccacttagagagccttcttgtatcacatgtaattctggtaaaatctctttatttccatatttcgcatttgtaattaatttttgaacagctatgaaatcatctcgggagataatagcttcgtgatgtccgacttttctgtattgattacggtcttgattgtttttccttgatttatggtcaagataattaggagtccatgtttttctcgccagaacatccccacaatggcgttcattttgaaggatttgtagtatggtactggatgaccagacatcattattcttttttgttttacaaccgagttctgtcaaagaatcagcaatttgttgagtactgcttccattcagatacatataaaaaataagctgcacaattttagcttcatgtggattgattacaagatctccattttcgtcttggtcatatccgagcagaggaggtgtaaggaatattccccgacgaaaacgcatttcaatggaagaattcataatttcacttttggtatgactttcttcctgtgcaagtgttgacatgaatgacagaatcatttcgcttttgggatcaagagtatttaaatgctctgtttcaaaaaatacaccgacgggtggacggagtgaagaaagctctcgtacatatcggatacagtcaacaacgtttcttgcaaatcgggatacactttttgttatgattaaatcaatttttccggcttcacaatcttcaatcatttttttgaatgcatctctatgttgaagcgaagtgcctgaaatgccttcgtcggcatatatttcgacaagcatccaattcggatttttatttactacatcctgataatgatttttctgtaattcatatgaggatgtttgacgtggatcatccgtagatacccttgcatatacagctactcgtagttttttttctgttttaaaaatatcctctggtggaagtgccggaattacttccagttcttctggatcaatacctttgtatctttgccggattctggctttctgttcatcaatattactgcttcgttcttcactttctttcatcaatagcgacatcctttatagttgatataactatcatagaatttttggattgaaaaagacataaaccatcagttaagtgattaacagatggtttatgtagaaatagatatttgattgttattgaatgatttaataatcattcgggttatcagcatcgtaattgtgttttgaggatagatgccaatcattgattcgtaaaatattctttatggctgaaagaacctcgaatatgtaacgtttttcagtgctggtacaatctgccattaataaatcaatatcagtttgatattccgtaggattgtataacaagtttccatagagtaattcatcaatagtaatttcaagggcattgctaattttgattaaagattctaaactgggtttacgcttggcattttctatatagcttatataaacagtagaaagatcagcgatttcagccagctcctcggcagataatcctcgttgtttgcgggtttctcttatacgtttgcctataagtgcataatttatttccatgtcctcacctcctttccatcacaacttgacttttttgtgttgtagatagaaaaaatggtgagttatacaatagtaattggttgtataaaaagaagtatatcatatgtatatagcaaaaagaagattgtcgattgatgggagaaaaaggcgataagttgtaattgaacaacagcgaaaaaaaggttattatttatgtattaaaaattatgtctgagaggaaaatacatggcagataaagaggaaattaaaacactggaggaattagaggaaaaaggaagaatactgcgggagtacaaagaaaaattccggcagatgtgccaagaaaataaaatgataaagggttcgacagtgctgaaactatatgataaaattgaagaaatacaaagagaatatgagcatttagataataagctgacattaatggaatacaactttatatagttctattttttttgttttaatactactgtttcccttagtaaatacttgcaagatacatctctaatattttttcggatttctagttacaattaaggtaactactatcggaaagaggtgtatttacttgcgtacagaggattatattgcggacaatattatagctttatgtaaaaaacgtgatatgagtaaatatcggctgtcacaattgactggtatatctcaatcttcgattggaaaaattattgctaaagaaagtttaccaaccatgcctactgtagaaaagatatgtgatgcactgggagtaacaatggcacaattctttgccggaatggatgttccagtaagcttatcagaatcacaacaagaggttctgaatatttggaataatcttgatgaaaaagaacagaatgtagtgatacaaatgctccggggacttcaaaaataaaggaaacagttgtaacgaaaatgttgactgtttctttttttatggagttgggagattatggtgattgaaaagaaatattatgatattgcacagcgtgaattggaagaaatgcaaagagaaattaatgcagaaaaagcgcaaatgtcagaagaagagatactagaggataaaaaatggcatgatgaacaattggaaacaattataaaaaaggcagaagctcatatgcgtcgttttaagaaagttccagatcctcaaaaagtagtgaaattcacttttttacaaaaagatgcattggaaattgcccgaaatatgcagatgaatataaaaactgagcgtaaagaagatgatttatgggggacgatagaaatgtcatttaataatatgtggtttttagattcggctcctagtgaatggaaagatatttggaataacttgatgaaagaagctcagagagtgtatatagaagcaaaagataacatgatcatgtatcaatattattatgatttggcggtagaagttccttgtgtgtagacaaaatacaaataatgatatatgaatgctgttctgtaataattttatgatatactgtggatatgatatgtaaaaatagtcggagaaagatttgtgaatgtacgattatttaggaggaaaaagcatgacagatgcagaacaaagagaggctgcccgtcaatttgtaaaccgatggatgggaaaagggaaagaagatgaagatggacgttcttattggattgatttattgacgaatgttttggaaatggataatgtgacagaacgtttgaactttgaaaagaaagttgtaattgatggaaatacaaaacgtattgatgtatatattcctgaaacacgagtaattattgaacagaagagtcttggaaaagcattggatcagaaaatcaggaattcaggagatgttgatcttactccatttgaacaggcagacagatataatgggaagctgacttttgatgaaagagctcggtggattgttacgtcaaattttgctgaaatttggatttatgatatgaaccagaaacagccagaaccgacaaagattgctttagatgaattacaaagcaaatatccattgttggacttcttggtgaaaaaggaagtaaagacaatatcgcatgaaatggaagtatcaataaaagcaggaggtattgttgggcttctttatgatgcgtttttaaaacaatatcgtataccagatattaaggaaaaggatgaaacatttgagcagaaagaaaaaagagagcataaactaaagagcctgaatgctttatgtgtgcgaattgttttttgcttgtatgcagaagatgctggtatttttggaaagagaaatatgttccatgattatttggaaacatatgaagtaaaggattgccggagagctttaatagaattatttaagatattggatacacctgtatcagagcgagacgagtatttggaggaagagcttgctcagttcccgtatgtaaatggtgggttatttgctgatgaaactattgagataccaccttttacagaggaaattaaagaattacttcttacaaaagcgtcagaagattttgattggagtgatatttctccaactatatttggagcggtatttgaatctacattaaatcctgagaccagacgttcaggaggaatgcattatacatctattgaaaatattcataaagttattagtccgctttttttggaagatttgcaaaaggaatttgatagtattagagcaattcaagtgaagcgtaccagagataaaaaattggaagaattccaaaataaattggcatcacttacattttttgatcctgcgtgtggttccggaaatttccttacagaaacatacctgtcgcttcgtcgtttggagaatgaggtgataaaggaaaaagttggcggacaaatgacattggtagaggtaaataatccaattagagtttctattcagcaattttatggaatagagattaacgattttgcagttacagttgcaaaaacggctttatggattgcagaatctcaaatgttggaagaaacgaaaaatattgtgtatggatttaatgatgattttcttcctttaaagacatatgtaaatatcacagaaggaaatgcattaagaattgattggaatgatgtaattcctgcagaaaaattatcgtttataatgggaaatccgccatttgtaggagcacgttggatggcgtcggagcagaaggaagatgttgagaagatatttgaaggatggaagagtataggaaatcttgattatgttagttgctggtataaaaaagcagctgactatatgggaaattataatatcagagcagcattggtatcaactaattcaattacacagggagaaagtgtttcgattctctggaaaccgctttttgaatcaggtgtacatattgattttgcatacagaacatttatatgggatagtgaagcgtcaataaaagcgcatgttcattgtgtaattgttggctttagcagagctgtaaataataagcagaaaataatttattcaggtgagaacgcaattccggcgaataatattaatggatatttgcttgatgcagaaaatatattcattgaaaaaagaatgaaaccattgtgtaatgttcctgaaatagcattaggtgggcaagcaattgatggtggatttttaatattgacggaagaggaaaaggaagagtttttggaaaaagaaccacaagcttctccgttttttagacattatatgatgggaaaagattttattgatcgaaagccgagatattgtatttggcttgttggagctgatcctggattattaaaaaaatgtccgatgatattagaacgggtgaataaagtacgtgaatttagacttagtagtacaagagcgaacacaaaaaaagcggctgagaatccaactttatttgcatcaatacttgaacataaaaatcaatatattgcgattcccaaagtttcttctcagaatcgtagatatattccaatggattatttagatggtgaaattattccgggagacaaattattcactatgccaaatgcatcattttatgaatttggtgtattgatgtcgaatgttcatatggcatggatgcgagcagtgtgtggaagattaaaaagtgattatagttattcaaacacaatagtgtataacaatttcccgtggcctgtagtaacggagaagaatcgggaacaaattgaaaaatcggcacaggaaattttgaaagcaagaacattatatcctaatagtaatcttgcggctttatatgatcctttaacaatgccagccgagttacggcgagcacatactacaaatgataaagctgttatggctgcgtatggctttagtacaaaaatgacggaagcagattgtgtgggagagttgatgaaattataccagaaaatgcaatgataaaagtttatagagctgttttttgctcaaagtaaaatatttgaaaacatagaatattccaaatccataaaagatgaatgaaaaccaatatgggaattttacaggtattacaaaatttgtaaaattttcatattggtttttttgtaatctgaaaaaattataaatttggatatctagtaaggtatcggatttttgatttttatgtatttttcaattttggatatggctccgaaattggcaattttgcggaagtgtatccacacttcctgtccttgctgtttttaaaatcacatagtgatttcacagggatatagagatatttagtctattttatatccctgtgttgtgaccggaaaaattcggggaaccaagtgtatatttatgctgaatgtgaggaactggggagcacaatcctcagcaagaatcctacgtccggaaaatatcatattgctaaaatagcgatatggtattaccggggtggatcttgctctagtgtgtactgagacctcggcataaatagaaaaatgggtttggggaatccccagcaagatgaaaacctgatgagagaatattgtgatgaaagacaatattgttaaacacaggtggatcttgctctggggtaagaaagaagtatctttatattatcaaaatgatatttggagtttatgttgttggaaagtcgtaagcaggaagataacttcaagttgttggtgcaaatataatgaatagaagtgtccagtacatttttggtgatgggtattttggtggaatccatttttatttatttttgaataataaaattttgaatctgcagccgattctgcctgccggacaatatttttagatatctgtaaacgtcacggactggaacttgatgaagaaccatcgtatgatggaagaaagtatttggaaacacgatagaagcaaacgctgtacttatcgtcttgtctggcagggaagattattaggcattaaccagagagatatcggcagagaaaacagaagtgatagacaatgatatttgttagatatgcttcttgtcgttggctgcatcatattaaaacgctttttacgttaaaaaagtgctgtgatcacaaggctttttgcaagcaaaaatgaaaaggctatatataggtagcctgtgaaactggaagtgcccattttgggcctgatttaaagaataatgttctgacagagaccaatggaatgactctctgctggggctccaaaagaaaggaaaaatgattatggaaaaaatgatgaatacaaaaacagagggtaacacatttacaaagaaaatcgggcagacagtctatgttgtccgttatcatttcaatgaaaatgcaaaggaaacaatgcaggagaagattaaccggatgctggttacagaagcaagtcgacaggcagtgtattaaaattaggtggatgtaattgaagaaaaaatatgatatcatgtgagtaacaaatcggaaattgtcttgatgaaaaatagatagtttatagtggaacatctgtcagaagcggcaggtgttttcttttggctcttgttgttcctgaaatcatgagcatacacttctaactaaagggtgatgggaattttgtaaaccataaaaataaacattgacaatcatctatgcataatatataatagaaacatagacgattatctatgtaaaggaggacaatatgaatacaatagatgtagcacttatttgtaaagcattgggagatagtaatagattgcagattatccaaatgctctccgacggagaaaaatgtggttgtaaactattggaggcttttgagattacacagcctacactttctcatcatatgaaaatcttaaatgaatgtgggctggtgaatgattggaaagaaggtagatggcatcattattcattgaattgtgagaccttgaatgcctttaaagcttttattgaaggattatcctgctgtaaagaggaaagtgggtgctgtcaataatgatttgggagtttattcaaaatcagattttgggaatgaaatggatgagtacattaattggaaatcttcttgagaaaattggcttggatacttcaagtaggatgggtggaagtgtacagtttttcctatatgatgttttgaagataacgatattgctttgtatcctgatttttatgatttcctatattcaaagctactttccaccagaacgaagtaagaagattatggggcgttttcatggaatctgggcaaactgtattgcagcattacttggtacggtgacaccattctgttcttgctcgtccattccactgtttattggatttaccagtgcaggacttccattaggtgtgacattttcctttctgatttcttctccaatggtagatttaggaagtctggttttgctgatgagtatctttggatcaaaagttgctatcatatatgtgattgtagggcttgttattgcggtaataggtggaacaattattgaaaagcttcatttggagaatgaagtggaagcgtttattcgaaaagcgaatgcggtcgatattgatatggatgaaccaacgcaaaaagaaagactttcttttgcaaaacaacaggttatagacacctttaagaaagtatttccatatattttgattggtgtcggaataggagctgttattcataattggattccagagagctgggtagaaaagattcttggcagtgataatccatttggtgtaattctggcaacgttggtcggcattcctatgtatgcagatatttttggtacgataccagtagcagaagcattacttgcaaaaggggcacagcttggaacaatcttaagttttatgatgggtgtgactacactttcgttaccgtcaatgattatgcttagaaaggcagtgaaaccgaagttactaggaatttttattgtaatatgtgcagttggaataattattgttggatatttctttaatgcaattcagtatctactggtttagaaaaagaaaaaaggagattgaaattatgagcttatttggaaagaaaaaggacgaaaagaaaatggttaaggaacaatcaggttgttgttgtggaaattgcaatgaagaaagcgttgaggcagcaaaggaaactctttcatcaggagcaaatgtgaaagttcttggtggcggttgtgataaatgcaatgcattggagaagaatgtgaaggaagcgcttagtgagcttggcatgacggatgagattgaccatgttacagattttggtcagattgcggcaatgggagttatgagtacacctgctctggttattgataataaagtagtctcaatggggaaagtattaagtaaggatgatgtgataaaagcattaaagaaagttaggggataggtatgaagaaagtagcgttcatttgtgtccataattcatgcagaagtcaggttgcagaagcattgggaaagcattttgcatccgacgtatttgaaagttattctgctggaacggaaacgaagccacaaataaatcaggatgcagttcgtattatgaaagaaatgtatggcattgatatggagaaagaacagtattcaaagctgatttcggatataccagagccagatattgctatttctatgggatgtaatgttggatgcccgttcattggaagaacatttgatgataactggggattggatgatccgacaggaaaatcagacgaagatttcatcaaagtaattaatcagatagaactgaaaataaagaatatgatagataggatgaaatagacagattcaagtttgtagaattcaaaaatttaatatgaaatgtgagatagagcgtatggaaataatctatacgttctatttttttgccttttttgaaaaagtgattaaaaaactattgacattttgttactggtagaagcagatggttataaaaagcttttgataactatgagtgcaaaaacagatagctgcgaaaatttattatgagctaatagcaaaatttgatattttgtgatattgagggtacggggaatcgtaatctccattaagttcgtcagagaatcataatccagaaatgggattttgagttactctaggcgatacttactttagaaaatgatttgccataatgagttagaatatgggaggaggaagcgttaaaaaaagagagagccataagcaactctctctgtgataaaatcaaaaagttatagtatcagtgattcggtaagattacaaaaatccttaacaggaatattttctttaagtggtaaagctgtctctaaaaaggtttcgtctgcaaatctttcgagttcagaatcaaaatatataattgaagcatttgtatttaattggaatggtggaattgtaacaaaataatcataatcttcgtaagaaggagtggcgcaagaaactttgatttttccgcccaatttcaattttgcaaattctccataaatggcagttaaggcttttttcctttcttcatcagaagtaattctatctacatatctaatataccaataatctatatttccctcttttaattcaattaaataatcgtatgatctgggcgttccagattttattgtccattcaactttatgcagacttgtcatcatggaaagtccacgcattaaggtagaaaaaaacttttcatgcacctgaacagtagagagatccaaagaaaatccattgtctgcaattatcttttttcgttcccgtatttttttagaagaatatcccgttgcatcatataattcttggataagttctggatcatcaatggcttttgcaattttatcaatagtgcttttatatggtcttccagatcgggcaccgttgagcattcgtgaaatggttgcattatttaagcctgtttgttcagataattctttttgtgtttttttctgtaaaatgatttgaagtatattgatgaatctttcctgatcgtaaacgctgtcaggatttattagtgtgcctgaatttgatataaattcgttcattcaaatctcctcttgatttctttgactttgtataaattgacttcttgtattttatcttatcaattatatccctaaaaatcaatttaaaacataaagaaatcaaaaaatactttattgatatttcattaaaagtcaaagaagtcaaaaacgtaattgacatttcgacgtctttgtgtataatgtaaatcaagaagtcaaagaagtcaaacaaatcaaaaagaaaggaaggagggctgtggattgaaatatagggttgtttcgattttgaaagataatagaccacgttttttgattatttctgatattgaagaaattgaaatccttccatcaaagtatttgaagcatctggatcagattaatgcttctccgaatactgtaaaatccgccgccttcgcactttcatattattacaattttctgcaggagcaaacgataggattggatgagattatattgctatcttattcagagcagaataaacattttattgatttcttgtattgggttaagagtggaaagcatactgagcataatacacagacgagcaataagacctgcaatatgtatcttggtgcagtcttcagatactaccagtttttggcactggaagatgttttgccaatgcttaaagtcttacgagtaaaaaaagtatcgtattttgacagtatgggagtaaatcatcaaaatgcagtgaattcgtttaaaggtttcttcaaagaagaagaacctaatctggaagaaataacatccgaagaaatacaggagctgataaatgcctgttcgaatgatagagatcgattgctgatagcaatgatggcagaaaccggtcttagattaggggaaattctgggaatccattataccgaagatattgattttgaaagaagaacggttcgggtaaggtatcgtgaatacaataccaacttggcaagagcaaaaaatgcagaatatagaatggctttgttaagtaatacaacttttgagttcttggttaagtacatttctgataaccgaaaaagtctgatgaactcggagtatttatttacaaaattgactggaaaaaacaaaggagagccattagatgcggattctgtgtatagcatgttgaaaaggctatcccaaaaaacggatatcaattctcatccgcatcagctccgacactattttgcggaggaaagaagaaaagaaggatgggatttgaatgacattcgttttgccctggggcataagaaagttgaaactaccattaaatacttgggtgaaaataatgaacgattgatagaagcgacagatcaatactactcaaataatgaagatttataccaaattgcagattttctgtaaaaggaaggagggattaccttggcaatattaaaaattgttcctaagttatatcaggaaaaaatatccgagaaattaaaggaagaaatatctttagttacgaatggagaagcaaaatactataaccggttatacaaatttttccagtatacagatatacagtgtactgcagatattaactatgaaacgagaaaaatgtatatggattctcttgaaaaagaggatatttcagaaaaatataaagcggaattactgagcttatttgatcgtttaaaaatagaaaatatgccggatgtctattcacaaggaaatcccttctttgtagaacaggagttttttaagcaagacaaattgtttttgctgtatgtccccaataagaagaaagcacaatcttttcgtcaggtggtcgataagaatgatttgttatgggacttaacgaggatacattcatcacagttggtgcgacagacaaaaatattgctgtgtgaaattctgaatatggataaggtacaaagacatcgaagatattttttagaaccattaaaagcacttatacggttttgcgataagtacggaatagatgatattgaagaaatggaacaggcagacgaaaacagattttatctgtatttaaacaaggagtcggaaattataaaaaaacaggcttctaagattgttgagtttgcgagaagaacgttatttctaacagattcagagacaaattggcgagcgtgtatctggtatatggataggtttcagtttgataaatcgagaatcaatgccagttcacctgttaaaagcctttcgtttattaatatttacgaaaaagaaaatcgttggtatttacaattatacgcaaaatatttggtcgggatatctgatctgtctttatcaaatatccgaaatacaataagttttatttcacaatttttaaaatatctggatggacagagtaagaaagtaactgaactggagatgcaagatatagcggattatgtgtctgttttggatgagtccgatattaagtattccacttttaaccgatatatcacacatatgcatacatttctacagtttttgaaaatgaaaaatattgaagtgttgaagttttatccggaacgatttttaaaaaaaggtttttcggaacacaatgaaagaagtgttccagaaaaaacaattgctcatctaattaaggagctgccggcattcccagagcatttacagttgatgtatttgattttgttttgcacaggaattaggaaaagcgaggtttgtacaataaaatcgggagccttttattcacaaggcaatgagaattggatgcgcatatatcaaagcaaaatgcggagagaaaaagtcattcctgttcccagtttattggttggactggtgaatgattatgaaaaaaagtacggaataaaaaatggggagtatttattcaaaaataaaaagggtggtgcatttaatggacagacattttcaaatcagatgattcgggagtgtaaggctcgtgggattgcctgcggagattatatctttagagcacacgattacagacataaccttgcaacttcaatgtacggaaatggggtttctatacaaggggtacgagattatctaggacattcaagtgagaatatgacaaaacagtacattgatttcatgccggaacgtattgtatcggctgaagataaatatttctctaaaaatcagtcatttaaattgaaaggagcagaagatgatgaaaggtaatattaatttgatttcgtatgactgttatcaacaagctacagaaaaacagttggcaggactgaaatggaaggaaaacagggtgtactacatatcagagattcataatgaaaagatgcaggatgagatttatgggtatatcgatgatagatgtagacgtttgtcattatcaacagtagtaaatgatatttacagatttgatctgttgaaagaatttctgaatgagaagtgtacaagttgtagcagcatcactgataaaaaatgggaagaactggagagaagttataaagcatttttatataaaaaaggattggcgctgtatgttagaagaaatagaccagataggcggaatgttgagcaacaaagtagcgctcaggtttcttttctgaaaatgtattatgagtatgttgtgaagtgtaaaacagcaggtattccagaaaacgaaaaagatgtatgggatatgagaaagttggatattgtgccaaggagtaatccgattcgtggaagatatagattagattttcgtgagatcaggcagaaagaatttaaagagataataaagaaaatattgtatagccactgccagacaaaagcaatgggtagtataaaaggtgaattgcgtggattccgtcggtttgctagtttcatgtatgatcgatttccagaagtaaagcactttacagaaattagcagggatatgatagaagattatctggtttatataaaaacggataccggtcttacatcagtcagttacacgacagagctgtcggttttggataatctgttggatgaaatagggcgtgaactggaaataggaaatatatgcaacctttttctatccagtgattgcagagcatatgacaacgctttaccagaagcgtattcagatgcagaaatcagaagatttaattgtgcattaacaaaattaaagccccagttaggcagatgtttaataatacatcagatgctcggtacaagaatagaggatacgttgactttgcgaagggattgcttatctgagaaatctggacattattttataactattatccagcagaaaacaaggaaatacaaaagaccagttagcgatcagctggcagaattgattagaaaagcaatagaagtttcagaaaaggagcatccagattcagaatatatttttcttcaagataatggaaaattgtatacagattcaatgctgaaatatcatgtaaatatcatgatttatgaaaatgatatcagggatgataatggaaattattttgagtttcgtacacatcgttttagacatacttttggagtaaaacttacagaaatgaaattagatgatgatagcattgcaaggctgttggggcataaggatacacgaaccataccacattatcggcggttaagaaacgaagcattagcggaggatacaaaggctgtacgagatgaaatgaatgaattattagcacaatacaggagggaaaaggaaaatgcagaaacacgataaaatggtagcactggcaaaagaaaaaagtgcggaaatgacggaaacagcaataacagctattgaaacaatgtatagaaaaaatataaaaatttcagttgctgaacttacaaaactaacaggactttccagaggttttttctataataatccgaatgtgaaacaggtcatgatggaattgaaggaaaaacaacagggaatgatattgcgaaatcctaaaagtgatgctattgcaaaagcacaggaagcacggattaagagtttagaacagaaattatccgatagtgttccgaaaaacgaatatgaaagtcttcagaaaaaatatgaagaattacaggtgaaatatagtcaaatgaaaaagggaacactgttgaagatgtatgaccaattataggaagaaaaggagaatattttatgcagaacgaaatttatgatgagaaaaatggacttacttatatgttatgtggtgattattatttgccaaaattggcacttacagatatcgaaccaacttatgggaaatatgggatgcttcgtaaaagctatttacaggaacacagaaaggcaaaatatcaaatattgttgttacaaggaaaacttgtcgagcatttgaatcagattgatgcagaagcaagggatagggaagaacaattagtaaaacagatgatggagaaacaaggaattacagagaaattaaaaaggcaggacaacatggaatggacaaggaggatgaatgccatttgtcatgatgcagaagagatgattttgacggaaatgatatacacaaaaggataatgaactgcattggatagcaagaattttgcagcccggatagcaaaaaagtggaagtccggatagcaaaaaaaaggaagtccggatggcaagattcttgctgtccggaaagacaaaaaagtgagggattaaaaatgttggttaagtacataataaaagtgtttttatatttaattcttgcagtaatgacattgattcgctggttattaaaaattccgatgatgttgggaaatattttgctttactttttatcaattatatttattccgacaggtgttttgagttatggatttgcattggaatctgcaagagaatgtgggcgaatgataataattgggatggcatttggtgcaataccagactttgtcccatttttgggaaaaagtttagagacattggttgccaaactgttaagtatgacaaatgaatgagaaagtcaatatgaaagagggctgtgaaaggctctcttttctttttgcaactgtggaatggcaagataataacgttatatacagtgtatattaagtacagatattgtatttctgcatgatgggaacatagggagtccatataaaggcacttaatacggggcatgacggaagtctcagcaccggccatgcaaacagtccgaaggacatgctaagccgtctggaaacgatggtactgatgggaatggatcttccccttcctgcaattcagagacagatcgcctccggtctggatatcattgtacatctcggccgtctaagagataagaccagaaaagtcctggaagtaacagaagtcctgggatactgggaggaagaaatccacctgcagacgctgtattgctttgaagaagcatataaggaggcgatgaatgtaacagaagatgaagaaaaaagagaaatcaggatggaaagaaaagttagcggagactggaaaaaaattgcagaactttgtcaccgcgagaagcttatggcagcaggatatcacatttaaagaacgtggggcagccgggggaaaggctgccacactcattgggattatggcatggctctattaccggaagatatgggctgtgccggcactgatcccgctggggatatggctgtacagagaatttctgaaagaagagaaaaagaaaaaggaacaggaattccagaagcagttccgcgagatgatacagtctctgtcggcagcactgaacacgggctattcggtagaaaatgcattctatgaaacgcagaaagaattaaaaattctttatcctccggaggcccggatttctaaggaactattggttattacgagaaaattgcggatacatattccggttgaacaggtgttggaggaatttgcagaacaggttctgtcggaggatgtaaagagttttgtaaccgtattcgtaacggcaaagaaaagcggtggggacatgatcggtattatccgtaatacagcgaatcagatcggagacaagatagaagtgaaaagagagatcgataccatgctcgctgcaaagaaatatgaatttcagatcatgtcggtagtgccgtatggaattatcggttatatgtcacttagttttccggaattcatgaatgaattatatgggaatatggcaggaatcggggtgatgacattatgtcttggaatctacgcaggcgcttattatctgggaataaggatattgagaatcgacgtatagtgcgggtgacttgtgtactgttcatatccggaatattactgaccggagcagatgccgttcgttctgtaaagcagctacaaccggccattgagaggaatgattacggaaaagggtcaaagacggaagtcttagatgtaaaagtcggggatacaaagaaaaaaataagaacggatatagaagtatcggaacgccggtatacgacagaagagatacaggaactgttcggaaggatcatccggaggatggacaggctgatactaaatgaaaaccagacgccggatcatgtggagacagacctgaacctgatcacagagattccgggagaaccggtgacggtctcctgggaactggacaggtatgatgtaatgaatgttaagggcgagatacaggagaagaatattgcagaaaagggaacgcttgtaaaactgaatgcggtacttacttatacggaaaatgaaaaagaacaggcagcttatcagtgcgtggtctgtgtatatcctaagaagttaagcggagaggaaaagataaagaaaacagtaacggaaaatatgaaaaaggcagatgaaaagcagcgggaacaggaaacgatgattctgccggaacgtctggggaaaaatgaaattcgttattatcatccgtttaataaccggggaatgattgtgctcacaatgagcataatgatcggaatattgctctgcgcattacagaaacagaatgaaaaaaaggcactggaagacagaaaaaaacagatgcttaaggactatccggatattatcaacaaactgacattgtatctaggagcaggcatgacggtaaagcgtgcctggagaaaggtaaccgagggctatgcgagagaaaaagaagaagggaaaaagaggtacgcatatgaagaaatgatacagacctgtcatgagatggacagtggtgtgacagaatcggagagctatgagaatttcggcagacggtgtgacgttcaggtttatataagactgggggctttgttgtcacagaatctgcggaaaggaacaaaaggattgacagaactgttaaaactggaatccatacaggcatttgaagagcggaaagcacaggcaaaaaggcttggggaagaagccgggacaaagctgctgcttccaatgtttcttatgctggcggtggtactggtcattgtgatagtaccggcatttctgacattgcagatatagatgaaaaataaaagaaaaagaagaaaggggaatacagtatgtggagaattcgatatgcattacaggtattaagagacgaccgggggatcggggtggtagaagtgatcttgatcctggtcgtactgatcggacttgtgatcatcttcaaatcacagcttaccagtctggtgcagacaatattcgaaaagattaccagcgaaagttccggaatttaagtgtggtgagcaccggaaagaaggagatgacgacagggtatgtaagaggagaggtaacggtatatctgacactgacatttattctgcttgtctcgcttgtacttgcgttgacggaaagcgcatccatccagatggcaaagaattacagaagggcagatatgaaccgggcagtggagtgcgtatttgcggaatatcaaaaagaacttctggaacattatgatgtatttgccatagaggcaggatatgaaagcgggacatacagtgagcagaatttgttagaccgcctgtcatattacggtgcagatatggaaaatgatataaaaagaatccagttgctcgcagataagaatggagaattgttcatggatcaggccggtaaatacatgaaacacaaatacggaatctcatgggcggacaaatatcttggaagtacttccatctggaagaatcaggagcggcaggcagatgaaattaccagagaagaaaaagcgcagacagatcatctggaggagcttctgaacgggcaggaaatggaacttccgggcgaagagaatccgttggaacatgtagcaggactgaagcaggcaccgattttgagtctggtattaccgaaagaaacacaggtatcagaaaaacagattgtgtcagaggacatgccggagaaccgagagaatcagaccggtcatggaacatttgaagatgtggaatcggaaggaggaacactggattccgtattgctgggcgggtatatacaggaacattttgcggattttctggatgaaccgaagggtgggagcctggactatgaagtggaatatattctggctggcaggcaaagtgaccgggagaatctggaaacagtcgcgaacaaattagtgctgctgagattcgtgccgaattatctgtatctgcagaccaacagtaccagacaggctgaggcacgggcagcggcagggacattatgtacactgcttgcggtaccggcggttacagaagctgctgcgcagggaattcttctggcatgggcatacggggaatccgtgatggatgtgagaacattgctgaatggaaaaaagactgcagttgtaaaagatgatgcaagctggcagctctcattatccggtcttatgaagcttggaacagaggaagacaccggcgacggggcggatgtagaaggtggtatggactacaaagactatgtgcgaatgttgttattcctggaagataaagggaaattaacagtaagaaccatgggagtgatcgagaaggatatgcagacgatttacagccagccgtcatttcggatcgattactgtgttggaagaatggaagtggacacggtgtgtaagctgagaagagggatatcgtatagatttcagacatattacggctatcagtagtgcgtgtaagaacaatgacatgaggcggataaagatgccctttcaggtatcgttagaaatcccggaaatataaaaataataaagaaaggagcaggattcgcaaaatgagaaataatttattctccccctcacaacctatcaatcattcagtatctgaaagggtatctttatccgcctcaacacgattggaaaaattattccgtaataaaagaaagggaagcgttaccgtagaggcggcagcaacggtaccgctgtttttcctggcggttgtgacactgctgtaccttctggaaatgatggcagtacatactgcagtcaggagcagtctgcagtatgcaggaaaacaggcggcaaaagacacctgtatcacacagatgctgatgccgtcaaaggtagagcgtgatgtcgtctatgcaatcggagagacaaggatggaaagaagtatcattgcaggcggcagtagtgggatggactgttcggcatcaagaatgtctgtgcgtaccgggattggaacattgaacgcagaatatcaggtgaaaattcctgtgccggtattcggtatcagaccggtaaaatgcagggaaaccatgaagataaaagcatggagcggatatgaaaaagagggattatccgatatgggaaatgatacggtctatgtgacggagaacggtcttgtatatcacaaagattatcattgttcctatctggatctgtcgatccggatgacacatatgggtacggtgtctgatcttcgtaatgaaagtggcggtagatattatccatgtgaacattgcatgaaaggaaatgcaggaactatatacattacaaattttggagaccggtatcatagttcattgtcatgcagtggattaaaacggacaatctatgcgataccggtatcggaggcagcgggaaagggggcatgttccaaatgtggacggtaagccgtatcgtggcgatggtcatactgacaggactgtcgtttatggattataagatcaggaaagttccgagagatgtactgttattgtgtatggcaggaacggttctatatcaggcagttacacagaatatagactggatggtatcgctgggaggcgggctgatcggtatgatatttataggaatcagtaagattacacgggaagcaattggatacggggacagtctggcgattctgatacttggaatctatctgggagtatggggacttctggaagttcttgcgacttcattttttattctggggattcttgctctgggatgcgtgaccttgagacggaagaagagtcttgcattcccattctatccgtttctgacagtgggctatctgtttggcgtatgtatcggaggactgtgagatggaacggatcataaacatagataagaaacatgctctgaacggaagctttacagtggaaatgtccctgctgatgccgatgatattatttcttgttatggggtgcgtcctggcatgtttttattatcatgacaagaatattattgcgggagcagcatacgagactgctgttgtcggaagtacgaaagccagagaaaaggacggaatacaggaagcggaattaaaagccttatttcaggagcgggtcgggaaaaagtgcatcctctttccgggagccgtggcggtatgttctgtgagcaaagaagagatccgtgtgtcggccgtggcgaaaagacggaagatgtcacttgcggtagaaagcagggcagcggtaacagaaccggaacggtatatccgggatatccgcaggataaagaaataaatggggaatgaaagaatggaacgaaagataacgatagaagagcatgtattatataaagaggactatcagatgaagatgctgaaagccaattcaccggaaggattccttaaggtggcaggaagaggcatgaatggcagcagttattatgattatgatgtaagcggaaagatatctatgcaggcaatgtatacaagagcaaagttaaaggcggaggatatacggcaatttatgtaccagtttgggaatgtgctgaaagaaaccggaaaatatctgctggatatccactgtattctactggaaccggaatatatattttatgaggaagggcaattctttttctgctattatccgccggcaacgcaggatctatgggagaaattccatgtgctgacagagtacatggtgaaagttgcggattacgaggaagaagaatgtgtccggctggcatttttgctgcataagggaacgatggaagaaaattacagtctggagaaactaatcgcagaatgtggggaaagagaagaaaaagatatggaaaaaccagtaagaaaaacaatgatagatgaactgctggaagaaaaaagagagcggacatcttattacgatacggaagaacatgactggattacggaacaggagatgggaagctcgatcatgcgtgagacagataatctgtggatcccggtaaagcgtttcctgaataaacataaaaaaacaaaatggggagaatgggacggactgcatattgaagaagaggaattgtaatatttaagtaatctatgttatactgataaagacagaaaatgaatagattgaaaggtaacggacgatagaagatgaataagaacacaataaaagcaccatgtactgtattactggcagttgtgaatgtaatagtctttctagtactgtcatttcagggaatgacggaggatggaagattcatgttacagcatggggcaatgtatgttccatatctgataaagaacggggagtattaccggctgtttacgagtatgtttctccacttcggatacgatcatcttttcaataatatggttgtgcttgtagcgatggggtggaatctggaacttgagataggaaagataaagttcctcatcgtatattttataagcggccttgcagggaatatcctgtctgcatggtgggacatactgacaggaagcatggcagtatcggcaggcgcatccggtgcaatcttcggaattatcggtgcacttctgtatgtggcgatccgtaaccggggaaggataggagagatatccggcaaaggattagtgtttatggttgtgctgacattatattatggatttaccagtggcggcgtagacaatatggcacacatcggaggcctggcagccggcttcctgatgggagtattactgtacaggaagcgtaaggataaacgtggttccgttatgtaagacggagttaagcgtgaccgttccatgatgtgcctggatgatccggcgggtgattgcaagtccaagaccggtcccgtccggtttgtgagtgacaaatggctcgaagatagtcttctgatcttcgggagcgataccgcaaccgttgtccctgacctcgatatgcagagaatctgtctggagactgacagagaatgtaatgaccggcttctgggaatcaggagcctttttgttcagtgcatcgcaggcattacgaagaagattcagaactgcctgacggagctttacgggatctgcagatatttccgggagatcctcgggaatacgggaaacaaattcgatatctgtatcaacaatagaagcagcgaaggataaagcaatcctgcggaaataggtgcttgcacttaccggggtaagttccagacgttctccgttattgtaagaagacagatcctccaggagaaatttcatgtattcgatatcctgatgcagttccgtccaatgggaaaatgtaaggacttccggatgttgtgattcgataagctggagtgtactgtaaaccagtgtcagaggattacggatttcgtgacttatggtactgatctccatctgatgagaggttaaaagccggtttataagtgcttcgttttcaggattttcctgcataatctgttgtaatttgtcatggtctgtcgatgataacataataattaccgcccctttctgaggtatcagtttagcattggcggtttaaataatcaatcataaattttaaaagaaagaaggataagattatgaaggatgagaattgtattttttgtaaactggcgaatggagacattccgacagcgactgtgtatgaggatgaagatttccgtgtgatcctggatgccaatccggcagcaaaaggacacgcactgatcctgccaaaagaacattatgccaatctgtatgagattgatgatgaacttgcaggaaaatcaatgatccttgcgaagaaaatgatcacaaagctcacaaaagcactgggctgcgatggctacaatattgtccagaataacggtgaagctgccggacagacagtatttcattatcatgtacacatgatcccgagacataaagatgacaaagtcggacttggatggacgatgcatgagttgacagaagaagaaaaagaagatgttttatcaaagattaagtagataaaaggtaggagcgtaaagtgggaagagagtttacaggggaaagtgcttttgtggatgcatatagcgaatactttgacgctgtatacagggaggcactcagatactctggaaaccatcacgtagcagaagaaattgcgcaggatgccttcttcatggcatatgtacagaatggaaatgaatccaagcagcagatcaaagcatggatgctgatgcttgcaaagtacagagccatgaattatataagagaccataaacgcgaagtgtcgttagaggaaataacgatgtcggaagagaactatccggacgctctggttgatgacagttcagaagagtatgtgatagcgatgctcaaggaacaaggtttccgcaaactcggaattgatatattccgggaactgtatcagaaaaaggccagatggtatcaggcagtgacacttgtatattatgtagatatgccgcagaaggaagccgctaagcagatgggcgttacattatatgcattggaaggtatgctgaaaagagcaagaaaatggatgataaaaaggtacaaagatgagtatgaccgcttacacaatacataaaaaacaggtggaagtacaaccacctgttttttatgtattacagagataaatgcagatcagtgtctggcaacagattcgatcaggtcgataatggtatcgatggaattctgctgaggagaatttttcattgcctgaatgtacgtctcacggttctgataaaggtccgtgattgctttcaggaggacatcatgattcagttcctcttcttctagaacaacactgtatccctgacgttcgaaagaacgggcgttcaggatctggtcaccacggcttgcatttgcagaaagtggaatcagaagattcggtttgtgcagtgcaagaagttcgcagatcgcattggctccggctcttgaaataacaagatctgtcagagcaaagaggtccttcagttcgtctttgatatattcgaactgagcataaccttccaggtctttcaaagattcatcaattttgcccttgccacagagatgaactacctggaaagactgaagcaattcaggaaggacactgcggacagcatcgttgacggcaacagaaccaagacttccgccaacgaccatgatcactggtttgtcctgagtgaagtgcagaaattccaatgccttatatttatcaccggataacagttcctgacgaatcggagagcctgtgagaacagcctttccggcaggaagatgctcgatggtttccgggaagttacagcagatttttgatgccgatggcatggaaatcttattagcaagtcccggtgtcatgtcagactcatggataatggtcgggacatgacggcttttaccggcaagaacaacaggaacggatacgaagcctcctttggagaagatgacatcaggatgaaggatcttcacaagtttttttgcttcgccgagtcctttgatcacacggaatggatccgtaaagttctgcacgctgaagtagcggcggagtttaccggttgagattccgtgatacggaataccgaactgttcaatcagttctttttcaattccattataagaacctatatagtgaatatcatagtttaattctttcaggcgtggcagaagagcaatgttaggtgtaacatgcccggcagtaccgccaccggttaagataatacgtttcataattacctccagacttgaatatgtattattcttgcatacatcaaatataataaagattatatctatattatactttctgaaagaaataggtcaagtggcaaaactatggagaaatttacagaccagtcaaaaatttgagggtagcaaaatgaatgataagaaagacgaatttaaagaatgcattgccagagaatttgaagagattgccagagaggaagaagaatttctggaaaatgacaccagtcttgtcgtgcctgaagggacaaaggaagctgtcctcgcaagagtaagagaacagatccgtgcatatgagatggagcagaccaggaaagaagcagaagaaagagaagaagcaatcaatcatctctctgaagaagatcgcgaggctctggagctgggacgcaagatgctgaaggccgggatcggacaaaatgatccggaggaaccttccggaaagaaagttcgccgcaaaaagaagcctttgaaaatgtatctcgcactggcagcagttattgtctgtgtgctggcaatggggatcaccagtatgggaggtccggagaggattgtgcggatgatgacgcaggatgttggggatagagaggttgagaaagtaagtacgagtcataagataaaaatgatagaaagtgaagatgaagaaaaggcgtatcaggaaataagaaataaatttggtacagatgtggttaaattatctatatgtttaaataatatgaaatttgacacaatgaatttaaacgaagataagcaaatcgcagagatgtattatacatacaatgaaaagaccattgcgtattttataaatatgccatacagagataactcatggggagttgattttgaagatcctattgaaaaagaatatactaaaaaaatagaggattgttcaattgaagttacaatttataaattaaaagaaagtaaaaaatcaagttgtgttgcaaaatttaaatatgacaatatagaatatttattgatgggaacaacaacacaagaggaatttgaaaaaatattaaaaagtttagtttttcccaaataaaagcgacagtttttgaaaaattatgtgtattaatatatgagggcagaaaaaagtacgaatggaggtgagctatgaagaagaaaatcgtgtctgtatgtctgaccgcaatgctggtcggaggattgtcgatgacatccatgcaggagacgagagccgcggagggtaaagtgatagacggttcggagctgacgcatgaggaagagtcgatagggtatgatacgaagattaccagaggtgaggacttattaacgggttattccaagtgtacaaagcttgacaatggaaaaatctatgctggtggaacaacagttgcaagacaggttgtcaaaagtgtacagatagctgtaattgtagagcgagcaaaagaagaagacaaagaatggtcatactatgataattggaagaaagaaaataaaaataccaacagagccatgtctaacagaacgctttatgttgacggtggttattactaccgcgtacgttgcacacatgttgctaatagcgatatgagcagttcctttactgatggaatttacatcgactaacaatcctcaaaaagcatagaaggataagaacataagactaaaaaaagaagagcaaaacaaaaagattacaaatcaaaagatgaagagattaaagtaaagaagtggacggaaaaactagaaaccatgcagaccatgacagtcaaacagtagttgggataaagtgaagattacagctgaatgaaacaggtaaaacagacaaagcaaaccataaggtaatgtatataaaaaagaagacgacaataaaaaaaccataaataaattcatcaaaaagtaagtgcacaatatgtaggagcgaataataattagaaaatacaatgaaaaacaatgaaacaaacaatgtaactattaataattatttattcgtaaccagtcaacggaagttttgacgagggaaaagcagggtgtgaaaaaaaagagaaaaaaataccaaaataaaaaaatcaccaaaatgaaaaaggatacaagtctcccggtcgggggacgagtatccttttttgtgtctgcgttattcagattagctgctggcctattattcgccaagtgcctgtctcaaagctttggataactggtcaggacaagatgtcggtctttcaccacatctggttccttccaggcgcttgatgacttcgtgtgcatccattcctttaacaaggctgctgattccggatgtgttaccggcacatccgcctacgaattctacgttagcaattttatctccgtcaagttctacgtgaatgagacgagaacagactccggttggtttgtaatccatatctattacctcctgataatgttcttgcatagttttacataatcggtatcaacagacggaaaatctgttgactgccatacttcccgattataacagaaaaccatcaaattatccatacatttcgtcggttgaaatccattttcctatcgtctataataaggcgtaggtaaattcgtgaaacacaggaggatataaatatatgataggtattatcggcgcaatggaagaagaagttgcagaactgaagaaagatatgcagatcgaagagaccgtagagatggcaggtatggtattctgcaagggaacactcggcggaaaagatgttgtaatcgtaagaagcggaatcggtaaagtcaatgcaggaatctgtgcacagattctggtgagtcaattcggagcagatacattgatcaataccggtattgccggctcgcttgatgcacagattgatattggcgacatggtcatttccacggatgcactgcatcatgatatggatgcgactgtattcggtgatccggcaggacagattccgagaatggatacattgtcattcccggcagacaaggagcttgtgaagaaggcggtagcagcgaatgaaaaagcgaatccggatattcatacatttacaggaagagtggcgagcggggaccagttcatttccgataaggaagtgaaagaaagaatcgtgtcattattccacccgatgtgtgtagagatggaaggtgccggaatcgcacaggccgcttacctgaacaaagtttcgtatgtcattatccgtgctatttcggataaagctgacaacagtgcgacaatggactatccgacattcgaaaagaaagcaatcgcccatagcgtaaggcttatgaaagaattgcttccgatgatctaagacaccgggacaacctgcgcagtacagaatgttacaggatatgcacgaaagtgacagaaagcagcatttcccgtgcagaataggaagaacgaaataaagcgcccttctctttgatatacagtataatgcatatcaaaaaggagggctattattatgctggaaatgttattggacaagaagttgttatttgtgcttatggggatgctgaccggacttggagtggcagacaagtgtatcgtgagtatgacgatgaaacgtatgatagaggcggcgggaagtatgagcaaaagcaatcatccgttgatgcgcctggtccgggcgaaattcgagcatgcatgtatgatcagtgacacggtggaaaatgtaggggtatttgtggataaatatctgtacgaatacaaagtatgtggattgcgtctgcattcgctccggagactggaaaagatgtgttccggtcttctgatcgtaaccggacttgcgggagcgggaattacctgtcaggtctatggaatgggagacgaagcgttgcggatgggcgctgccggctgcggactcggaatcctggtgtggctgttccatctgacaacggacgagaattactgtatggagatggcgaagaattacatggttgattatctggaaaatgtatgtctccgcaagtatgaaaagatgaatcagaaggagcggaccgtgcgtgtaaacatagaaaacggaccggcggaagaggaaatacagaaggataaaatacaaaaagacgaaatacaaaaggatgagatacaaagggatgaagtacgggagacggaagccggaacagaagagacacctgcctcggtaccggatcacagtgtagtccatatgcagcgtgagaacagacggagagaacggactcaaaataccgcaaaaaatctggcaaaagcatcggcaggacttgccggtatggacggaagtaaaagcccggaagcggaagaacagaaagatgcaccggaggagcttgcaaaggacgagatgatacgccagattctgcgggagtttatggcttgataatataatgttattttgttaaaatatatgcatgtataatatatttgataaactaaagaattacagtgattccgactactacgcattccacatgccgggtcataaaaggaatctggatctgatggacgggacctccccgtacaggatcgatattacagagatcgatggctttgatgacctgcatcatgcggaaggacttttgaaagaagcgcaggaaagagcggcaaaagtgtatcatgcatcggagacgcattttctcatcaatggaagtacagccggaatcataagtgcaatattaggaacaactgaaaaaggcgattccatacttgtggcaagaaattgccataagtctgtgtatcatgcaatatatctgaatgaactggatccggtctacatctatccgaagttcgatacagaacaggggttgagtacagagatcgatgcagaagatgtgcagaaagcactggaagaacatccaaagatccgtgcggtgatgatcgtatcaccgacctatgacggcgtggtgtcggacatcgaaaagattgcagagattgtacatgaagcgggatgcctgctgatcgtagacgaagcgcatggggcgcattttggctttgatccgtatttcccggagagtgcgaatatgtatggcgcagatcttgtgatcaatagtcttcataagacgcttccggccctgacgcagacagcgttgctgcatgtgaacggggagcgggtgaaccgcaggaaagtaaagcggtatctggatatgctgcagacgagcagtccgtcgtacatactgatggcaagtatcgatgcgtgtattcatctgctggaagagacacaactgcagaagtgcagtattttcaaagaatatgcggcacatatcgataccctgcgggaagaattgaagaaactgaagtatctgaagattatccggacggagaatacagacagatatgacagatctaaatttgtgatctctgtaaagcataccccgatgtccagtcatgaattgtatgagagactgcttcgtgattatcacttgcagatggagatgcttgccggaacctatgtcctggcaatgacgacggtaggggatacgcaggaagggttggacagattgcgggatgcattgcttgcaattgatgctgagatcgatacaaagttaaagtcaggatccggacaggaagatgccgggcaggagcagaaaccgatgcaaatgaccgacacggatctcccgctttccggaagacagccgtcactggaaaaggtgtggacgatcgcgaaggcagtgaagtgcagagataagatgcagaaccagaaccaccagaaggattcagaagacatcctgtatttggtgaacccagacaagatggaaaaacgaaatttcaaggacagcgccggatgcatttccctggaatatgcgtacctctatccgccgggaagtccgctgatcgttccgggagaacgcattacgcaggaagcggtggagattctctgctggtatcaggaacacgatttttcaattgaaggactgcaatcagaagatagcatagaggtatggatagatgggtaagatattttacatgatgggaaagagttcttccggtaaggatacggtctataaagagatcagaaaagagcttcccgagctgaagacgctgacattatatacgaccagaccgatgcgggaaggtgaaaaagacggcgtggaatattattttgtttcgaacgaaatattagaacagtatggagaagaaggcaaaataattgaacttcgtacctatcagaccgtgtatggtgactggaaatatgctacaatagatgatggacagattcatctgaccgggtctgattatctgatgatcggtacgctggaatcttatatgaagatgaaagcgtattatggacaggagaatctggttccgctttatattgaagtggaagacggggaacgcctgatgcgtgcgatcgcaagagagcggcagcaggaacatccgggatacgaagaagtctgcagaagatttctggcagatcagaaggatttctcagaagagaatcttgcggcagcaggaattacaagaagatatcagaatgacgataaagtacgatgtaaggaagagatagtagaggtaatacgagatgggaagctttaaagatgtggttggtcacaaagacatattaaaatatatcagtagcgcagtggagaataacagagtgtcgcatgcgtatattctgaatggggagagaggttccggtaagaggatgctggcgaatctgttcgcaacgactcttttgtgtgagagcgggaacagtgaaccttgcgggaaatgtcattcctgcaggcaggcagagagcggaaaccatccggatattatccgtgtaacacatgagaagccgaacagcatcagtgtagatgatatccgtacacaggtgaacaataccgtggatattaagccgtatcagggaccatacaaagtatatattatccctcaggcagatctgatgacaccgcaggcacaaaatgcaattctgaagacgatcgaggagccgccggcatatgcggtatttttactgctgacggagaatgcagagatgctacttccgacgatcaactccagatgtgttatgctgaagctgcgtaacatcaaagatacactgatcagaaagtatctgatggagaatctggagataccggattacaaagcagatatgtgtaccgcatttgcccagggaaatgtgggacgcgcgatcatgctggcgaattcggagcattttaatgagatcagagaggaagcggtacagctcctgaagcatatccatgatatggaactgagtgagattgttgctgcggttaagaatatatccgtatataaattagagatcacggattatctggatattatcatgatctggtacagagatgtcttactgtataaagcaacaaaagagattgacaaggtcgtattcaaagaccagttacagagtataaaagaacaggcgagaaaaagctcttatgaaggaattgaactgatcctggagagccttgagaaagcgaaagccagactgaaagcgaatgttaactttgatctggttatggagcttttgttcctgaccataaaggagaactaatcatatgacgaaggtaataggcgttagattcagaaccgccggaaagatctatttcttttcgccgggaaaactggaggtagagacgggcgataaggttatcgttgagactgcaagaggagtggaatttggttctgtagtcaccggaccgaaggaagtggaagacgataagatcacacagccgttaaaatccgtgatccgtcttgcaacagacgaagataagaaaaaagaagaaaagaacaaagaaaaagaaaaagaagcattcaagatctgcctggagaagatccataaacacgggctggagatgaagctgatcgatgcagaatatacatttgacaataataaggtgctgttctattttactgcagacggacgaatcgatttccgcgagctggtaaaggatctggcaagtgtattccgtacaagaatcgagttaagacagatcggtgtgcgtgatgagacgaagatccgcggagggatcgggatctgtggcagaccactttgctgtcatacgtatctatctgagttcgcaccggtatcgatcaagatggcaaaagagcagaacctttcactgaatccgacgaagatttcgggtgtctgcggaagactgatgtgctgtctgacgaatgaagaggagacatacgaagaactgaacagccatcttccggcaaatggtgatcatgtcacaacaccggaaggcttaagaggagatgtccagtctgttaacgtactccgtcagctggtgaaggttgttgtaacgctggataatgacgagaaagagatccgtgagtatccggcagcagaactgagattcaagccgagacgtaagaagaaagacgtaagactttccaaagaagagatgaaggaactgaaggcgttagaagaaaagaacggagcgtcaaagttaaatgatgactaaattacttccgaatgaaagactggatgacctgcagatcagaggatacgagatcatccagagtccgggacggttctgttttggaatggatgcggtgcttttgtccgcatttgcaaatgtgaaaaagcacgaaaaagcactggatctcggaacaggaacggggattcttccgatccttctggaagctaaatatccgggcctgcattatacaggactggagatccaggaggagagtgcagatatggcaaggcgcagcgtcagccataacggactggaagagaggatcgacattgtaacgggagatatcaaggaggcagcatccatattcggagccgcctcttttggagttattacgaccaatcccccgtacatgatcggagaccacggactgaagaatcagaatacagcattgtatattgccagacatgaggcactctgcacgctggatgatatattaagagaaagtgcgaaactattgaaggtcaaaggaaggttttacatggtccacaggccattccggcttccggagatcatgacaaagatgtgcgcatacggaatcgagccaaaacgtatgcggctggtatatccgcatatagacaaagaaccgaacatggttctgatcgagggtatgaaaggcggaaatccgagaatgcaggtggagccgccactgatcgtatatcagaaggatggaagttatacagaagaactgcttgagatgtacgggatgaacaagagcgagcataagatggaggagtaagagatggcaggaacattgtacttatgtgcgacaccgataggaaatctggaagatatgaccttccgggcggtgcggattttgaaagaagcagatctgatcgcggcagaagataccaggaacagtatcaagcttctgaatcattttgagattaagacaccgatgaccagctatcatgaatataataagattgaaaaaggacacaaacttgtggaacgcctgcagaatggtgaagatattgcagtgatcaccgatgcaggtatgccgggaatctctgatccgggagaagaactggtaaagatgtgccaggaggccgggatcacggttacagctgttccgggagcctgcgcatgtgtgacggcgcttacgatatccgggcttggaacgagaagattcgcatttgaagcatttcttccgacggataagaaggagagacaggctgtcttgaatgaactgaaagatgagacaagaacaatggtgatctacgaagcaccgcacagactggtccgcacgttgaagacgcttcgggagacgcttggcaacagacgcatcagcatctgccgggaactgacgaagaagcatgagacggtatttgccacaaagatagaagacgcactggcatattatgacgtacaggagccgaagggagaatgcgtcatggtgatcgaaggaaaaagcagggaagagatccggagtgaagaaaaagccagatgggaagagatgagtatggaagagcatatggaactctatctcggacagggcatggataagaaatccgcgatgaaacaggtggcaaaggacagaggcatagggaaaagagacgtctatcaggcactgttacagacaccttgaccttaaataacgttccgttcgtcaacttgtatagaaaatgaaaaaaagattgttcaacttgggcattacccaggttgaactttttttatatactttttatcagaacgaaacaggtaacaaaatgaaataaaacgattataaatcaggaggattataacaatggcaagtttatcattaaaacacattaacaaaacttatccaaatggatttgaagcagtaaaagacttcaaccttgagattgaagataaagaatttatcattttcgtaggaccatccggatgtggtaaatctacaacactccgtatgatcgccggtctggaagatattacttccggagaactgaagatcggggacaaagtagtaaatgacgtagagccaaaagacagagatatcgcaatggtattccagaactacgctctgtatccacatatgacagtatatgacaacatggcatttggtctgaagttaagaaaagtaccaaaggaccagatcgacaaaatggttcgtgaggcagctaagatcctggatctggaaccactgcttgaccgtaaaccaaaagctctttctggtggacagagacagcgtgttgctatgggacgtgcgatcgttcgtgatccaaaggtattccttatggacgagcctctttcaaacctggatgcaaaactccgtggacagatgcgtatcgagatttctaaactgcaccagagattaggtacaaccatcatctatgtaacacatgaccagacagaagctatgacactgggaaccagaatcgtagttatgaacgcaggtattgttcagcaggtagatacaccacagactctgtatgattatccatgcaaccagttcgttgccggattcatcggatcaccacagatgaactttgttgatgcgaaatgtaaagtagtcggaaatagagtatacctggtagcaggaccttcagagatcgagcttccaccggcaaaagctaagaagctgatcgatggcggatatgaaggaaagacagttgttctcggaatccgtccggaagacgtgcatgatgagcagatgttcatcgaagcttctccaaatacagtaatcgaagcaaagatccgtgtatatgagatgctcggtgcagaagtattcttatacttcgattatgaaggatcaagcatgacagcaagagtggatcctagaacaacagcaagaacaggtgatattgttaaatttgctctggatgctgagaagatccatatctttgataaagagacacaggttacaatcacaaactagtctgtaatgaaggcttggtataagagccgcaattatcgtaaaaaacagatgaatataagaggaccgggcgtaagaaagcgtccggtcttttcgtttttttcgcagacaataaaattttgctttgttaaagcatgattatctgctataatgtattcgtaatgcagttcgttagcgtgctaaaatgtatacaagtatgcaaaagaacacgaagaacagcattgcggataggaaatggaggacaatgcgtgttatcaaatcagatattacacaaaacagcacaggatatcagggagattacaggatttgactgtgcaatatgggatatgcagggattctgtctcgtaaggacgaatgagactctgaccgggtatgagatccagatccaggatttccgtgatgacgaagaagaaccggaagagatgatcttagatgagatgggaatgttccgcatctatgaagacagtgatccggtatatgtattgatgctgcatggaaatgcagacggcatggaactggcaggacgtatgggagccagtcagcttcggaatcttctttatgtatacaaagaacggatggataagaaccggtttattcagaatttgcttctggataatctgcttctggttgatatctataatcaggcaaagaagatgaagattccggtagaacttaagagagtcgtattcgtgatcgaaccgaagcatgaaggagatgtcctggtacaggaaactctgaaaggtctgtatgcgacgggaacaaaggatttcgtaacggcaattgatgaaaaacatattattcttgtaaagtcactgcagtctaccgacagctatccgcaggtagaacagatcgccaaagagctggtcacgacgctgaatatggaagccatggtaagtgtaagagcggcatatggaacaattgtagaagaattaaaggatgtatccagatcatacaaagaagcagatatggctttggaagtcggaagagtgttttatacagagaagaagatccttgcatacaatgaactcggaatcggacggctgatccatcagcttccggcatcactctgcgagatgttcctgaatgaagtattcgaagatggcaaggccgatattttcgaagaagaagaactgacgacagtttatacattcttcgataataacctgaatatatcagagacggcaaggcgtctgtatgtgcacagaaatacgctggtgtaccgtctggagaagattcagaagaaaacaggactggatgtgcgtgtatttgacgatgcactgacattcaagattgccatgatggtagcagatcatatgaaatatgtgaaagaataatcaggttagcagatgtctggactcagacattttaatatattcacaatacgatagtaggaggacaaaacatgctgaaattatatgacaagggagtctatttactgaatggaacagagattgtggaagaaaaagaagcagttgctgcaaagacaggtaaagatgtgactccacaggaagctgcaaagaatacaatggcatataacattctggcagcgcataacacctcggaaaatatggagcgtctgcagatcaaattcgataagctgacatctcatgacattacattcgtcggaattattcagacagccagggcttcagggcttgaaaaatttccgatcccttatgtacttacgaactgtcataactctctttgtgcagtcggaggaacaatcaacgaagatgatcatatgttcggtctcacctgcgcgaagaaatatggcggagtctatgtaccgcctcatcaggcagtcatccaccagtttgcccgtgagatgctggctggcggcggtaagatgatcttaggctcagacagccacacacgttatggtgcacttggaaccatggctatgggagaaggcgggccggagcttgtaaaacagcttctgaataagacatatgatattaagatgccgggggtagtcggaatctacttagacggtgagccgatgaaaggtgtcggaccacaggacgtggcacttgcgatcatcggtgcgacattcggcaatggctatgttaacaataaagtgatggaattcgtaggacctggtgtgagtaagttaagtgcggacttccgtatcggtatcgatgttatgacgacagagacgacctgcctgtcatccatctggaagaccgatgataagatcaaagaattctatgacattcatggaagaagtgaagattacaaagaactcaacccgggaggtgttgcttactatgacggtatggtatatgtaaacttaagtgagatcaaaccaatgatcgcaatgccattccatccgtctaatgtatacacgatcgatgaagtgagaaccaacttaaaagacatccttcatgatgtagaacagaaagcactggtaagtctcgatggagcagttgactattctctgcaggataagattgtaaatgggcagctatatgtggatcagggaatcattgcaggatgtgccggcggcggatttgaaaatatctgtgcagcagcagatatcatcaaaggacattatatcggttccgatgagtttacattcagtgtatatcctgcaagtacaccgatctacatggaacttgtgaagaacggagcagttgctgaccttatggaagcaggaacgatcgtgaagacggcattctgcggaccatgcttcggtgccggagatacccctgcaaacaacgcattctcgatccgtcactcaaccagaaacttcccgaaccgtgaaggctccaaacttcagagcggacagatcgcatcggttgcacttatggatgcacgttccatcgcagcaacagcagcgaataagggattccttacacctgcaactgacctggatgtggaatataaaggacagacttatcattttgataagaacatttatgcgaaccgtgtcttcgacagccatggtgtagcagatccatcggtagagatcaagttcggaccaaatatcaaagactggcctgcaatggcagcacttccggaaaacttacttctgaaagtggtatctgagatccatgatccggtcaccacaacagatgaactgattccatccggtgagacctcttcttatagatccaaccctctgggacttgcagaatttgcattgtccagaaaagatcctgcttatgtaggccgtgcgaaggaagtacagaaagctgaaaaagcaattgaagcaggacagtgtccgttagaagtattagatgaactgaaaccggttatggataagatccacgagacatatccggagacaggaaaaggtaatctcggaatcggaagcacgatttttgcagtaaaaccgggagatggttctgcaagagagcaggcagcatcctgtcagaaggtactcggcggctgggcaaatattgcgaacgaatatgcaaccaagagatatcgttcgaacctgatcaactggggtatgcttccatttatcacggaggaagatcacgagaacttaagcttccgtaacggcgactatatcttcgtgccggagatcagaaaagcagtggaagataagaatgccgagatcaaggcttatgtggttggagattctctgaaagagatcacgctgaagcttggtgatatgaccgatgcagaaagagagatcatcctgaaaggatgtctgatcaattattacagaggataatatgttttatttttggtaccgttttgttttggaaaattttgatctgacattcggacttatgtatacagcaggaaatcacggatttcctgctgttttttcttatacggagatgtagacactgccgaaataaggaaagttcttgtataatatgataaaatacctgcaacaatgtgagcgggaaaagactcttatctatataggatttataataattaccggaagattaaaaacagtgataaaagattcatatctgagggaggttacgatatgatatgcagtgtaaaaaggttctcggaaatgtatgaaacggtttaccgtgatctgtaccattacgcactgtgcctgatgaagaatccgcaggaagcggaggatgcagtgagcgaggcggttgttgcggcatacgagaacatacataaattaaaaaaagaagaagcattccgcagctggatatttacaattctgacgaataaatgtaagaagagattgaagaaggcattaaaagaagagccgggaagagaggaagaacttccggaacagccggttgtaccggattatgatctggcaatggatgtcaggaaagcattcttcgtgttatcggaagaagaacagatattagtcggattatccgtattcggcgggtattgcagtcaggagatcggggaaatgatgcggctgaatccgaacacggtacgatcgaagcggagccgggcacttaaaaagatggaatgtgtgctgggcagttacggagaaacagagcatggaagaaaggagtgagaagtgtatgcggcgtgagaatgaacatgaaaaaaagcagaacggatactgcgaacaggatatggtagatcagattgcacgattgtcagaaaacacagaggtaccggacagtctgagaccggaaaatatagaacggttactaaaagggaaaaagcagaagaaacattttcattcataccggatcggacttgcagcagcctgtgtagcagttgtaacgggaatcatagtgtggcagtatggaagcctgcatcatggaatgacagactctaaaaggatgtcagcaggtaatacagaaaggaagatcagcggcagtaggaagatcaggatagccgaaagttatgatgaaatctataaatatatcaaacggtcgcaaggtaacgaaggaattgcaatgtatgcaagaagtggaaatgagacatcggcagcagcggatacaggcagtgggaatgagacatcagcggcagcaatggacgcagatggcgggtattcgcagaccaatgtccggcagtccggtgtagatgaaggagatattgcaaaaacagatggaacgtatctgtatgtacgggaagataatggccggacgatcgacatcatagatgccgggaaagggcagttggaaaaatacaatgagatcactttggaaaaagaatatatggtccaggaattttatatagatacagaccggaagaaactggtggcggtatgtcagaaagaatgtacagatgcagacaataaaaagcaggtcggtacagctgtccggcaacagacaaaaactgcggcagtcacctatgacatcagtgatatcaaaaagccggtaaaagaaggtgaagtaacacagagcggtacttacaattcatcgcgcatggcagacggatacctgtatctgttcagtgagtattatacaggaagtaatgtggttaaagataaaccggtcacctatgtaccgatggtgaatgacaaagcaatgagccaaagcagtatctgcctgcctccggaaaactgtggaatgatgtacgaagtgatcagttccgtggatatcagtaaaccggatgaaacggcagatcataaagcgattctatctgaaggcggtcagatgtatgtcagcaaaaaaaatatttactattatgaatcagggtggcagcaggataatcagactgtgacaacacttagaaaaatttcttataataaggggaaattaaaggcagcagcacagggaaaagtaaaaggttatctgaatgataccttttcgctggatgaatacaagggcaatttaagattattcacgacaaataatgacgaaaatctggtgacgatactggataagaaactggataagatcagtaccatcgaaaatctggcaaaaggcgaaaccatctattctgcaaggttcatgggcgaatccggatattttgtgacatatgagcaggtcgatccgttattcagtgtagacctgtccgatccggagaagccaaagattctcggtaaattaaagattccgggattttccgaatacctgcatttctatggagaagacagactgctcggtatcggaatgtcaaccgatgaagaatccggcgtggcagaaggagtaaaaataacaatgttcaatatatctgaccggtcagatgtaaaagaagaatctacacttgtgctggatgatctgtacggaagccatgcggcatatgattataaatcggtgcttgccgatccggagaaaaacgtaatcggattatccggttacagccagaatggggaaagctattatctactgacatacaaccggacagacaggaaatttgagacaatcctgcaagaagaagtcaatggaaatacatctcagggaatccggggaatctatatagaagatacgctgtatgtgatcagtggaaatattattgaagcttatgatatgaatacgggtgtgaaaagcggagatatcatattataaatttaaattgggatttaatttattaacggggaagcggcctctcagtccttgaaggaaacaatagataaggattcttgttcagagaagttatgcagaacaatgggaattggaatgtctattatagcaattcttgcattgacaatgggcttgcttgaaaatattttgcctgcattttttgtatatattgcattggggattattttggttgatgtcgtagtaattatcattttaggaaatacactatgcagaaagtaacaactttttagtttgtatgcgacaaacgtttgaacactttttgaacaccgcaaccgtgatgaagtcttcaaagcccctttctatcagtatttgagattaagtaaaacggttcgattccggtctgcggcattaggttgaggtgcctcaaacccttataattatagggtttgaggcactttttgttttacataaaaagttgtacaaagttgtacaggcagtatttacagggcttaggccagtattcgggccatttctgttgagtctcgttcggtagtacgttgtccgatgtagtgctgggtcatcgcaagattcgaatgtcccaagagtggctggatgtcaattgcttttacaccagcatcaaaaagcatcgaggcgttggtaaagcggattttatggctggaaagatatgtaatccccagttcaccgcaatatttctttaaacgccggttaaacgtatctgtagtaagcggccgtccctcgtgcatgaatacaagctttccatttggattaagctctttcatttttctcagaatattaattccagcttctggaagttcttcggtacgtatactgtaaaagggattgccttttggatcctttaagacacgatgaggatgactgaaagtcatatcctcttgtaacgtacgttcttctaccaattgctgcttgattgtgataatattttcgttctccgtatcccaagttaatcctttgatttctccgactcgaaaaattccataaaacgcgaattgaattgcaagtgtgtaggcatcttgctctaaagtctttagataagacagtagcatagcatgttcttctactgtgtaagctttttttgaagcatttggcaatttgaactttaatgtgttgcaaggaagatcggtaataggactaaatgtaataatttcatttagcacagcatgacgaaagatgccatttagtacagacttacggttgttaaagtcctttctggtaatctttccgtttccggtccaaatttgaaataatttcattacatgtactggtttgatctctgcaatttgcattcttgctaattctgtatctgcaatgaatcggttccaaattccgatgtcctcttcaatcgttttctgagatacgatttgggtttctgcacgatgctgcacccactgcttgtagatatcttctaatgtgttattgaagtagtaatcatagagtttctgcaccagctctttttctgatggtgcaataaattgtggattataagatttatatcgtccgtctttgcaagcatagaactctttgcgctttttgtctttgaaataaatttcgctgactagttttttcttttttgcatatgtcatgtccgtgtattgcgacatctctgctatgtttaatgtagcactttcgattaatgattgcaaggcgatgatcgtgttgtacaaattctgttgttctgccgttagttccgggttttggaatttgttttgcactttttaaaagttacaactcctttcaatgatagtttcccctcatatatagtagtgacagaaaggtgaacgaggtttggcgtataattattggtaaatacatattgcgataatagtgaaagaacagttattgaaagttgtacgaaaaaaaataagggaaaagaagggattgaagaattttgtccagaaacaggagttctaaaaagaatctgacattactataaaagagaagatgatggctgtctcaaagagatggaatttgtaaaaatgtaaaagttgcaaaacgtttctgtcatactactacatgtaggagattttttactgtacaaaagaaatatggagaaaatattggattgaaaaattttgttcagaaataggagttgtagaaagaatcttacactactataaaggaggagatgataatagtggaaaagagatagaatttataaaatgcaaaagttacaaaacgtttctgacatactaatatatgtaaaagtgtttttaaaagagttaccaaaagagaaaaatgattaccccttagaacttaatactgacatccggtgttgcgagccacattccggcatttctaccgcgggaaaaatcgcactaatatcctagtaaatgagaagtaatggagcacacaaattcaggggaccctcctgctaggtaatgctgacggtgaacgcaaccgttctgtgacgagcagataaattgccaggcctggaatagacatgagggtattttaccctgggtgaaggaagaccagctgtaaacaaatggaaagctgattacgagggcatgtagagtgaaggaaggttactgtgtggacctccgtattttccttactgttgaacccctattagctgcatacaagataactatgtttttttgtctgcggctagtaggcgttccctagctggccgaacgccttggctaaagcggaaggacgctggaacgctttcggctgtgagtccatctaagggatgcggttctacagaacggcgattcggacagcggacgcagccgggaacttatggagaaggccactacttccgtggccaacccgctacgggtaacgaaaacttataagtatatagaaagaaaagaaaaagaaaagaaagaaataagatatagagatacctcttatcttccctttagatacagagagatacacaagggaatacagaggatagacatgaagagaatagggaatgaatttaagagaagataatatatattttcctgtactttgtgtatgtacagctaatgggaatattcttatactttagataaataaaaaataggaggtactataatggcaaaaaagatattaatcactggaggagccggatacatcggtagccacacagcactggaacttttaaatgaaggatatgaagtggttgtatatgacaatctttgcaattcatcaaaagaatcattaaaacgggtagaagaacttaccggaaagcacattacattctatgaaggagatgtaatggacgaagctgctttaaaagaaatgtttgaaaaagaaaacgtagatgcagtaatccactgtgcagcgctgaaagcagtcggagaatcggtacagaagccattagagtactaccgtaacaatataacaggaaccctgacactgatggatgtgatgaaacagacaggtgttaagaatattgtattcagttcatcagcaactgtatacggaagtccagaagagatgccaatcacagaggagtgcccgaagggacagtgtaccaatccttacggatggacaaaatctatgatggaacagatcatgacggacgtacagaaggcgaatccggatatgaatgttatcctgcttcgttactttaacccggttggagcacatgaaagcggccgtattggagaggatccaaagggaattccgaacaacctgatgccatatatttcacaggtggcagtcggaaagcttgagaggcttggagtatttggtgatgattacgatacaccggatggaaccggagtccgtgattatatccatgttgtagaccttgcaaagggacatgtaaaagcaatcaactatattttcagtaatccgggattggatgtgattaatcttggaacgggtgtcggatattctgtacttgatatggtaaaagcattcagcaaggcttgcggaaaagagattccttatgaaatcaaaccaagaagagccggagatattgcgatgtgttatgcagatcctgcaaaggcagcaagagttctgggatggaaggctgaaaaaggactggatgagatgtgtgcagactcatggagatggcagtctcagaatccgaatggatacgaaaaataataaagatattattatcgtaaaagaatttaagaaatgaaaaagtcatacgaattcagaaaaacaggagaaatggtggattacatcgtttctcctatttttctgaatataacatacaatattcgataaatgatttcatgttttttgtcaagtgtttgtttcgatgcaaaataagatttaggttcctttttagaggttttggaaaagatagatatgaaacacggtgttccaggatatcttttttaatcatcatttcaggaagaacagaaacaccaagccccattgcaacaccttgtacaatcgcttgagtactggaactttcccataatggatggatgtgtatgtcttttaaagaaaaatatgcatccaaaatttcacgaccagcacttcccttctctctcatgagaaacgggtgtagggctagttcttctaaagtaatagacgttttggaagctagggaagagtctggtggaacgattgcacaaagtttgtcttccataaaaggtcgcaaaatgatatctggatgttcggactgattttcaattagaccaatgtcaattttattatcgaggatatgttgttcgatggctgaagacttattaacaatgacttcaaggcgaagatcaggattatgtttttgatattctttgatcagttcaggaagaatatgagtaccaattgtgatgcttgccccaatacgtagagtcccgatattgtcccagttttttatatgttgctccatttcgttaaatagtgagacgatatgaatggcataaccataaagatgtttagcagcttcagtgggagtaattccacgaccaatccggtcgaataactgaactccatagtattctcctaattctttgattgcaagactaacagagggttgagcaatgtgaagtgtatttgcagctttggttatgctcttatgttcataaactgaaacaaaaatatgaagatgtcgtaatgtcataattttcctccttaaaaatatataataaaatcattatattttgtatataataatagtattttacataagtgtcaagcaagaatatactaaaaagcgatgaaaggaaagggaaagaagatggagaaaaaaaataagaagaagatgctgtggaagatatttatttcaacattatatctgagtgcttttacttttggtggtggttatgtaattgttacgttgatgaaaaagaagtttgtggatgactatcattggattgaggaaaatgaaatgcttgatttagtggcaattgcacagtcatcacctggagcaattgcggtaaatggagcaatagtagtggggtacaaattagcaggaatattaggaactatagttgcaattatcgggacagtgattccaccatttctaattatttccataatatcgttttgttataatgcatttcgtagtaactactttgtaagtcagatgctagaaggaatgcaggcaggagttggtgctgtgattgcttctgttagttatgaaatgggagctggaataatttcgaaaaaagatgtggtatctgtattgattatgataggtgcatttatagcagcttgtatttttaatattaatgtaattttcattgtgattatatctggaataattggaattattcggacatgcgttatcgggaaggagaggatgtaaatgatttattgggaattattcctaagctttttgcaagttggtttatttagttttggaggaggatatgcggcaatgccgttgattagagggcaggttgtaacggtgcatcattggcttagtatgtcagaatttacagatttgataacaatttcccagatgacaccaggaccgattgccgtgaattcggcaacatttgttggaacaaagattgctggaactctaggagcgttagttgcaacatttggatgtattttaccatcgtgcattattgttacagtaattgctagactgtatttgaaatatcggaatatggctgctttgcaaggaatattgaattctctaagaccagcagtggtggcgatgattgcagcggctggcatatcaattctgattacagctttttgggggaatacaggaatgatatcgctggttggaacaaaatggactcttgttgtaatttttatgatatgtgttgtattattacagaaggtaaaaatgaatccaatcggggttatggctttggcaggcattatgaaggttggaatatcatttattggaggataggatgaaaaatataagcgtactaattaaaccggcatcaggtgcatgtaatatgacatgtgattattgcttttattgtgatgaagctgcaaaaagagaacaaaaattttatggaatgatgagcgaagaaacattgaagaatatgattaggagaacaatgcttcattcggaaggaagtgtaagttatacctggcaaggtggagaaccaacacttcgcggactagatttttttcgtaaggcgctttatttgcaaaaaaaatacaatcgaaatcacttgcaggttattaatgcatttcagacaaatggttatggtataactgatgattggtgcatgttttttaaagaaaacaagttccttgttggtgtatctgtagatggccttccagaaatacatgattcgatacggcataataaaattggagatggaacatttgaacagattaataaaaatataaaattgctagataaatataacgtagaatataatattttgactgtagtaactccaaaagttgctaagaatataaaatccatttatgcattttataaacaacgagggtggcattaccaacaatatattgcttgtctggatccatatggtgaagaacacgggaaaatgtcttactctatcctgccagaacaatatggaaaatttttagtagaattatttaaattatggtataaagatttgcaagaaggatgtcatccatatataagacaatttgaaaattatgtgggattagcagcgggatatatggctgaatcttgtgaacagcggggaaaatgtggagttcaatatgtggtagaagcagacggaagtgtatatccttgcgatttttttgtgatggataaattttatcttggaaatttaaatacagatattatatcgaaaatagatgagaagcgtaaggaagtgggatttatagaatgctcagaaagagtgaatcaaaaatgtaaaaattgtacatattacagattgtgcaggggagggtgtatgcgaaaccgagaactaggagataaggaatatttgaattatttttgtgaaggctatcaaatcttttttgaacattgttatgaagagattctgaaactaggtgatagagtaaattatagataaaatgggcaacgtttaattaattaaaaaggtggagtgaagtttattcatcccaccagtttggtgtatttattgtgagtaaagactgctggaattcctttggagggattccggtagtctttttgaatactcggctaaagtataaaggatcattaaatccggtcatttgtgcaatgttagacaaactcatggaattagtagcaattaactctttggctttttcgatacgaagctctgttaaatacttcatgggagaactcccgattctttttttaaataggtgcgagaaatatcctacacttaatttacagtattcagccatggattcgacattccaatcatccatatacgtctgatttagttgaattacaagacggtttatagaaaaatcatttccaaatggggaaagaatctgttgatgggatcgtgcaattgtggcaagaatctgccaaaaattgcttaataccatatcttcaaaaaaaggtttttttaattgtaattcaatgataacctcttggaaaaaagttttcagtaaactatgttcgccgatgtaacaattatgtagattgtatttttggattattttttcacaattgtaaccagtaaagtgaatccaatagatttcaggatgctccttaaaaaaataagaataggtttgtgcttcctttgggcgaaacagaaggacatttccggcactgagagatttccactttccatgaatgtaatagtgtccggcacccttataaatataaattagttgatagtctactcgtcctgctgctcgattttgtttatagtcctttgttttgaaaatctgcataccacaacagtttacagtgagtgctgtagaaagatcttcaaatccagtggctcttcgttcgtttctaagatgtcctgatacatttatcataaaaatctccattctgccagctagaggcgacaaaaaaacaatacagtatgccttatctatcatcataatcaaatgttgtttaaagagcaagcattagaaaaaaaatgattgagaaaagcagaattatccatgttaaacgcataatttgacatagaaatggcgaaaatataggaatatactaggtcaagcagatgagcaaaagcagaattaagtatattacgaaaatcaaggaggatagaatatgagaaagcaagtaatatttctgatgactgatacaaccagaaaagacatggttggatgttatggatatcctaaaatgaaaactccaaatttggatcgcctagcagaagaaggaatccgatatgaaaatgcatatacatgtcagccagtgtgtggtccggcaagaagtgcaatctttactggtacattcccgcataccaatggaatggtaacgaatagcattgcattgggtgataatgtaaaaacaataggacagaggttatatgatcatggaatccaatgtggttatataggaaaatggcacttggatggatctgattattttggaaatgggcgttgtccagaaggttgggacccagaatactggtatgacatgaaaacttatttaaacgaattaactgacgaagaaaaagtaaaatccagaaaccctaaagaatgttataaggatgacttttcggaagagtttacatacgcacatcgttgttctaatcgagcaatcaaatatttagaaaagcatcaaaataatgattttttcttaagtgtatcttatgacgaaccgcatggaccatcactttgcccgaaaccttataatcatatgtatgatggatttaaatttgatagttgtcctaattttcaggatgatctttctaaaaaaccatttatgcaaagactttggtctggtaagaatttacatgcaacagaagatgaaattaatcgaccgacagatggattatcactgtttttaggatgcaattcatatgtagattatgaaatcggaagagtattggataaaatacgggaagttgcaccagatgcacttgtaatttttacatcagaccatggagatatgcttggggcacatcgattgttttctaaaaatgctgcagcgtacaaagaggttgcaaatattccgttgattatcaaaggtggagccaaggggtatgtagaagaagcaatggcatctcatatagacattgcaccgacgatattggactattttgatattccaattcctaaacttatggaaggaaagagtatgctttcacagattgagaatccagaaaaagaaattaacgatgtgatctttacggagttcacaagatatgaaattgatcacgatggatttggtggattacagattatgagggctgctatatccaaacggtataaactggtaattcatttgttggattcagacgaattttatgatatggagaaagatccatatgagataaataatttaattgatgatgaaaattatgtggaggagcgcaatgcgttgcatgataaattaattcaacatatgaatgatacaagagatttatatcgaggatatcagtggagaatgcgtccatggagaaaagacttcgttccaaattgggaaaatgaaggatatacaaggcaaagagaaaatgaagagtatgaaccgagacagttggattatgatacgggacttccgatgaaagaggccgtaagaaaaaaatgctaaatgaagacaaggagagaggacaatggaagaaaagaaatatttaaaatggtataataaagtaggatatggatcaggagatatagctggtaatgtggtatttgcattcttatcttcgttcattatgatttacttgacaaatactgtaggactgaatgcaggtgtaattggttcattgattgcagcatcgaaggtattggatggtatatcggatgtcgtttttggatcaatgattgaccgtactcatacaaagatgggaaaagcaagaccgtggatgctcggggcatattttggatgtgcaataacattgattgcagcattttctgtaccaacaacaatgggaaagacatctcagtatgtgtggttttttattacatatttgttgctaaatgcgggattttatacagcaaataatatcgcctattctacattaacggctttaattacaaaaaatgtcaaagaaagagtacaaatgggatcaattcgattcatgtttgcatttggaacaagctttattattcagactattactgttggattggttcagaaacttggtggcggagcagaaggatggagaacaattgcaattatttatgcaattataggtttaatttcaaatacattgactgtattttcagttaaagaattgccagaagaagaacttcgaaatggagaagaaaaagtagaagaaaaatacagcttgattgaatcaattaaaatgttggtacataataaatattacattgtgattcttgtggttgacattctcagacaaacttattcggcgattataaactgtggaatttattatatgacatatgtgcttggtaaagcagaattactaggaacattttcgggtgcgattaacttggctcttattgtaggacttgcatttttaccaatgctggtagcaaaatacaaaggatattataagttgaatttttctggatatttaattgcggcagcaggaagaggaattgtaattattgcaggatatatgggaaatgttccattgatgttagctggtacagcaattggtgcgattggtatggcgccatggcagggtaacttaaacgctttggttgcagaatgttcagaacatacatttttacaatatggaaagagaattgatggaacaatgtattcttgtacatccatggggttaaaaattggtagtggaattggtacagcaattgttggatggttacttaattttggcggatttaatggtcaattgaaggttcagtcacagtcttgtattaatatgcttcatttcatgtatttatggcttccgatgattattaatatattggtagcattattattgacacaattaaatgttgaaaaagcaaatgaaaaattaagaattcaaaaagaaattggaataacgaaataaacatatggcggttctgggaaaagggccgccatatgtaaatagacagtgttattttatgcatattttcgaacatctgctgtatatgaatttaataattgaaaacgtataatagcagtaaaaataaagaaaattcagaggagggcatacgaatgatcgtacctaactattacgaaaaccttcaggtgcttcatgaaaatacaatgccatatcgtgcatattatattccggcatcaaaaccaatgggcacacttgttcatgacagagaaaagtcggatcgcttccagttgctgaatggagattggaaatttaaatattataaaagtatttatgacttacaggaggagttctatcgggaggagacattgacggaaacctatgatgaaatcccggtacctggaatttggcagaattatggttatgacagccaccagtatacgaatgtacgttatccgattccgttagatccgccatatgtaccacaggaaaatccgtgtggaacatatatacatgaatttgattatagcaaagaggaaaaagctccgaaagcgtatctgaattttgagggcgtggattcctgcttttatgtatggatgaatggacagtatgtaggctacagccaggtgtctcatgcaactgcagaatttgatgttacagagtttatgagagatggaaaaaaccgtctggcagtattggtattaaaatggtgtgacggaacatatctggaagatcaggacaaattccgaatgacaggaatcttcagagatgtgtacatcttaaaacgcccggaaaatatattatatgattattttacaacaactaaaataaatggaactgatgcggagatagagatccgtgcaaactttgtaggagaaggaaatattgcagaaaatatgaagattcttctcaagaatgaagatggtacatccgtaagtgaaggtcatttcgaacgagtggcggaagaaaacggatatacacataaagctacatttataattaagaatccaactctttggaatccggagcagccttatctgtatcagcttatcttgttctctgatgcagagacgattgcagaccgggtcggaatccgtgagatttcaagagacggaagtattatttacatgaatggtgagaagatcaagttcaagggtgtgaatcggcatgacagtgatccggtgacaggttctgtcattggtattaatcaggttaaaagagatttgattatgatgaaacagcataactttaatgcagtgcgcagcagccattatccaaattctccatacttttatcagctctgcgacgagtacggtttctttgtaatcgatgaagcagacaatgaaagtcatggaacgcagacgcagtatttacaaaattcagaatgggataatgtcgttgagcagtggaataaacgaattgcgaataacccggatttcataccggcaacgatggatcgtactaagctgtgtgtataccgtgaaaagaaccgcccatgtattgttatctggtctatgggaaatgaatgtgcttacggatgtacctttgaagaagcgttagaatggacgaagaaattcgatccgacacgactcacgacatatgagagcgccttttatagaagtacagacagaacttatgattatacaaatattgatatcgtaggaagaatgtaccctgcgtttgatgaaattgatgaatatatgaaagaacagccggataaaccacttctgctggtagaatactgccacgctatgggaaatggaccgggagacttagaggactattttgaactgattcagaaatacgattctttatgcggtggctttgtgtgggaatggtgtgatcacgctattgataaaggtactgcagaaaacgggaagcggatctactactatggaggtgatcatggagaagaaatccatgatggaaacttctgcatggatggtctggtatatccggacagaacaccacatacgggattgaaagaatacaagaatatttatcgaccggcaagagtaacttcgattgatcaacaagcgggagaaattacattacataattatatgaattatgtggatttaaaagattacctttatgttgattatgaattaagcagagatggtgagacacttatgacaggtagcaccgaaatagaaaagagtattccggcaggtgaagaaggtacaataaaaatccctctgtatgttcctgaaagcggcaagtgttatttgaaagtaaaatattacctgaaaaaagcaacgcagcaaatgtatgatggggaagaacttgggttcgatgaaattttgttagaaaatacggattcacgtaatcagaaagtgaaaaagctgttagaggattgcaaggaaaaccagaaagtattaacgtcattggaagttacagagacggacagctatcttacgattggtattggttctccaaagtgtctgtatatctttaataagcaaagtggagtatttgaaagcctgcaaaaagaagacaaagaattattggagcgtccgatggaatttaatatttggagagctccgacggacaatgatcgtaagattaaagaagaatggtataatgcgcattataatcagagctattccagagcttacgagacaacttatgaagaaatagaacataaagtaatcattcattgtgtctctgcaatagtagcgccaacggtacagagaattttgaatataaaatcggactgggaaattacttgcgatggaacaatcaaagtaaatatgcaggtagagaaggacatggaatttccaatgcttccaaggttcggtattcgcctcttcatgaacagaaactttgacgatgtagaatactttggaattggaccggatgaaagttatattgataaatgcagggccggaagtcatggtacttacactgcaaaagtagatgatcttcatgaagattatttacgtcctcaggaaaatggaagccatacagactgtgattatctggaaattaagaataaaaatacagtgtttacagccataggtaatcagccattttcgtttaatgtatcttcttatacacaggaagaactgacgaagaaaaaacacagttatgaactggaaccatcaggatatacggttgtatgtctagattatgcacagagtggaatcggatctaatagctgtggtccagtactttcggagaaatatcagttgaatcagaatcattttgaatttgacatgacattaatttggaaataatgaaatagagaaaagaaaaatgctattgtcatcggtttacagatgacaatagcatttgtaataatcagcataaaaacaaattacattattgaaataattttttaatccttttaaaagtttcatttgaagtcctcctttatttttttatttatccttgttacaagtgtattgtaatatagaaaaagaagagatgcgtgtcaaaagaatagaaaaagtagacaaaaattgcaggagaaataaaatgttcccagtatacgagcagaaaaaagaaaatgtacatatattacaaaaaacatccagacatgcaccgccacatctgcataattcggttgaattcatatatgtgataagtggaagtatggaaattggtatgggacaagaactgttccatatggacgaaggtgatttcgctgtgattttcccggatgtaattcatcattatcaagtgtttgaaaaaggaaaaaataaatctatgctatcgagctaggctttaaatatttgatgactaaaaaaaatataaaaatagaaaaagaccatgatttgaaagaattatataaaaaactggacgctgtagaaaaaatcgatgaggattatatggaatatgtggatactttctgtgaaaaatattgtaaatatattgaaggaggcaatccagaatatttcagatatccagagtataaatctagtcaatattttgcgggtaattgtctggatgctaaatggttatcttacaattttgcactgatattattaaaattattacatttggccgatttagagaaagaaatataatcacaatttgctaaaatacatcaaaagttttgaaaaaaattattgatgtattttagcagataaacaataaaaatgtggctttgatagataaaatattagttgcattatggacaatagtgggctaattgatataagtaagtatatttgaaaaacagatactgttaaattaatctggagagattatgctaacggagtgtgtggaattatcttcagagaaaatttttttccgatattcggaaggagaaaatccagtctgttttttaaaaatccggctaaaataaagcggattctcatatccaataatatttgaaatctcagttacattataatttgttgattctaagagcactttcgcattatgtatccgcagagagagcagatattgagcgggagtgctgtttgtatattgcttgaagttttgaataaaccagccttcacttaggttatgggcagcagcatactctttgatgctgagtggttgattataatgttcctgaaagtattgaactgcctgatcgagacatggatacaaaaatccccggccacattcctgcagccggagcaccttgacaattcacatatgattgattattgatttgagtcgcttgcacgacgttcgatttcagccttgacctcttcgttccatggagcaagcctatctaactcttcatcactcatcctatcattcgggagtttttccagaagataggttagatagtgatagacgtttactccatttgctttcgccatttctaccattgtgtaggcgatagcactggcctgggcgccgtttggagtatcacagaacagccagttttttcgacctactgtaaacggacgaatagcgttttcgctgagattattagaaaaactgcagcgtccatcttccagataggtcataagataggatcggcggttctggatataagtaactgctttatccattcttgatccgcgcacagggttctgtttatcaagccacgacaaaaagccttctactatcggcttttctttttcaaggcgagctttcttgatagcatcgaaggatgagtacttcgctttgatcacatcttccaaatggaaaagctggttgatatacatcatgccttgaacagatggctgtgtataatccagttgctttcctttcggaattgcatctgtcagatatctgcggatgtgtgcccagcaggctgtccgtttggcatcaggcactttgttgtaaccactgtaaccatcgcacatcagatatcctttaaatcctgcaaggaattctacggcatgatttcccgcacgggtttcagagtatttataaatgatgatcggagatccaccatcttctccactgcggaataaccacatgtaagatttggtctgtgcacgcctgccgggttcgtgtagtacctgaagcggtgtttcatctgccattgcgaattcccgtttcaaaagttgacggtggaagtaatcatacattggggtgaaataatccaatgtattacggattacccagtttgccaaagttgctcttgtaacggcaacaccatactgtgcccaatctttctcctgtctggtataagggaggctgttacaaaatttctgatatatgacccatgcgacagtatctgctgatcccagaccatggagcatatgcgcatgaccgtcttttccttttttgataacagtaacgtcatccttactgcattccggacaaatgtagtttaagctgtatatttcgattacttttaactttgcaggaacaaaggaaagttcgcggcgtacaaactcttcaccgatttttaccaacggagtattacaaacagggcagactttttcttcctccggaagatccagatattttttgactaccggaatccctttgaatcgctctgcgttagttgcacgggatttccgctttttaccttctttttctggcaagagactttccaatgcttctggttctgcaagagttggattctgttccagttcggcttcattaaataaattcaattgtcccggaacatccatggaacgtttttcgctggaagaaccgaaaagctttttgcgaagcagatcaacttcttcctttaaattatcccgttcctgagtaagagcctcttcccgtttgttagcggcatctacagttgcctgaagtgtttttatcatttttttcagatcgttgatcatgtctttcaactcacggagttgaaggtctttaaaactgtctgccactgcgttttcctcccgatttttgatacttctattataccagaaatcatggagaactcctagaaaaacaggacaataagaaccttgaaaaatgctgaattttcaaggaaatccagtgcttttatgtgcatctttttgccatatattttaagtggttttaatagctttgggctgctcgatatcgatacctgacatcagccagtcgaactctctccatgtgagattccgtacttctgatttatcccggggccaccggtaagaaccttgtgcagtcaatcttttataaatcatgacaattccgtcaggctcttttaagatagctttaatcctgtcgcatttgcgtccgcagaacaggtagagcgaatggtcgatttccatagagaagtgctcctgaataattgcgcataatccatcgatagatttacgcatatctgttctgccacaaacgatatagattgcatcgacattcgagatgtccgctagcataatggctcctttaatgcatccattaaaattttcagaagcataggctgaacggtattgctcatacggattgttaatccttttgcttcaatctcaatcgtatgtgaattgtcaaggtacatagaactgcttctttcatcttgaaacagttctgctggagaagtttccggctctatagcaatctgaacaacatcctgtttgtgggatgtaagatcaagagtgctggctttgccaatcggatctggtatctggcaggctcttttgcgcagacgggaaacggcattatagaagcaactcggagaaatcccttgcgcttcacaccatgcagcatcagttaatccactttgcctgcattccgttaccagttccatccagtcatccaaggaacgccttgggacacgtttatcactcataatgaaacctccaaatgtagtgaatttctacttcctatcaaagtagtggagtaaaaatctatcttctatcattatgagttaggaaacggcgaatatctagttacccaaaaactaagcgcttacttcaaaagaaactgctagtggagggttctgtagataaatgcgaaggtaagaggagaaacaatgcgatttagaaatttagcggaagaaatgacagaaaaagatttaaaagaagtattggaaataatatatccagatactattttttctggatacaaaagaatggaaagagaaataaagattttttttaaactgcatggaaagattaggtcttgtgtattgatgtcagatcaggttgtcgatatgccaagtggcatgaggttagataataacacgcaatatgagtttcaaaagtatatggttgctcatggatacagcgaattatgggtgaataacaagtatgcggatgaagcgaaaattgagtagaagcagagagagtcgatggattattgttttatgcgagaaaacataagatttcagtatcctagctattagataatcgtaatatgatgtttataataatataaaaatgtgatatgatttatttaaatgcattatagaagataatacgtagccaaattctatagttaggtgtataatatttataagtaatgacgtactacgtactattagaggatggtttgaatgcacaataagaaatataaagaaacatatagagaattaagccatggaacagatgtggaatcagcaactataatcagaaacaatggttttaaaattagtgaacgtagtgatagttggtgtggaccggggatttatttttatgatattaagaaaaaagcatggtgggctgcaaggagaaaatgtagtgaaataaagaaggaaactgggaaaaaagttgaaccaacagtactatttgctgatattattgatattgagactgataaaatctttgatttacgggcatataaggatttatgtgattttgaagaaaaaataacaccgttgttaggggaatattcatttgagttgtctgggatgaatgaaacagaaaaaattatccagttgagatcgttgtttattagctattatgcagagaaaaatgataaaaaattgattatcggtaactttagacagcgaccacaaccaatgtatgaacatgctatagaattttcaaatagtttggatatgatatttggtatagaaaccatatattgtgttaaagatagtaatataattgaaaatattcattaagggagggaatgtaaatgggaaaaatggaattagatgattttattaaatatgccaaagaaaaatttggctgtgaagtttctgtgaagatgtgtgaaaaaccagatacttttgctgatatttttggtgctagctttcttaatgataatgaatacatggaaaatattgatgatttcgaagatgagctaaaatataaaaacagttctattgaagtgcgggttatacttgaaggtgacatggatgtcgaatatgatagtaatataggatttgcggcataaaggagtacatatggaattaaataagatgagatctgatttaaaaatggataatttatactttcgttcttgttctgtagaacgagagtgtgaagtgaagaatggagagtgtaaggctaatctgcaacgtaagattataaagattcgcgaacatgaatataatgtagaattaaatttatcagtacaaaaatctgatttatcgatttcaattattgcagaagcacattttaagtatgaagcagaaacgtatgaaaaagaagagaacataataaaaactaatacagttgctattatgtttccttttatacgtagtcaggtcactttattaactacacagccaggaatgacaccaatagttttaccacctataaatacagcaaaatatgaatagtgaaaaagtagagaatattatatatgtagaagtttaatgtgtttggaatattcttttttgaagtattatattggaaagtatttataaaagaatgatgattttgaaaaagttgtacaaaagttgtacaataagagcagagatgccgcaaacctcctttctgtgggcgttcccgcgttcccgaaaaggttcgattccggtctgcggcattagaatgagttgcctcaagccttgagtttatcaaggtttggggcgatttttttatgctcaaaagtttggttacatttggttacattatatttcttatcatagatatctgcagccataccataattgtattcagttgtagcatgtgaatcataatgttgcgtttgctgaatatttgaatggccaaggttgtgttgaatatcctgttcacactgtccctgattttttgccagtgatgcacttgtgaatcgaagtttatgtgtagacagataagggatgtcaatctcggtcgtgtactttttcaatctcttattaaatgtgtccgtaattaacggccgtccctgacaagtaaacagataaggggatggttcgtgcaaagctaacatttgttcaataatgtttctattatagggtgtaagctcgataggacgaatagaatagtttgcatttccctataataatgtaaatttcttttcattatatagactaatataatccaatattataaatgtcacttattattttgactaaatgaattcaatataatgactagttcatatacattattatagagaaaaagaaacaattgctatttccttgacatattaaaaaatatggaaaaatttatgcaagaaagaatttgaaaataaaaaaggtgtgctgcatttaggggaggttttaatttacggggaattttaaaaggccttgctttcttggaataactttttcttttagagcagaaaaagggaaaaaatagataaaaagtgatgaaaatatgtattgaaccccttggaacatagaatttacatacattaaacccatcggaactcatattaaacccatatgcggtaagagaaattttaattgtgaaacaaattatatatcgagagtgctgttgaagctatatacttaaatgtatttcagagtggaaagacaaccggttaatacagcatatctgaattatcattataatggaaaatatattacagatttgcagtgattctcctgcttggcggtggagtcatggtcttcaaaaagaataaaaatctgaatacaggtttctagggaaagggcactgcccctttcctttttttgcaattcaactcataaaaaattgacagtgactgttctggcagtgaaaagtagaacaatagcatttgaaacattgagctgcaatggtgaacaggtaacgattgaaaatgatctggataatgaacagcagacacttcacttcccaatcctcagcacaacagcaaaaggaaaagtagtgatgcgtcggtaagtgatttctttaagagcatcaccaaggataagagtacaggctttctgaatgaatggaatgcaaagagaaatcgaagggagcgtatttatatttcctatgattctacgaataagaactgtcaggccggagagattgaactggctgaattcggtcatgccaagacagatatcggttcagctatcatcaactattcggttggatatgatcttaagaataaagaaccactcttttatgaagcctatcctggaagtattaacgacgtatcacagcttaggaccatgcttggtaaaatcactgggtatggctataaaaaaatcggtttcattttggacaggggatatttcagccgtggaaatatacgctatttagacgaatgtggttatagttttgtgatcatggctaaaggcatgtcttctttcataagtgatttgatcttagagaacaaaggaacgttcgaaaataagcgctcttgtgacatgaatgcctatggtgtgtatggaaaaacagtgcaaaggactttatttgaaggcgatgaaaaaaagagatacattcatatttatcatagtatttcaaaagatgctgatgaacgggagcattttgaaaacgcactgagagagcggacagctttgctgatgtcacatcagaatgaaacagtagagttcggttcagcttacgaaaaatacttttatcttcactacgataaagatggcgtgtttttatatccggaagaaaaaacaactgtgacagaacgggaaatatcattatgcggatactttgttattattacatccgaaaggatgaccgcaaaggaagcactgcatctttataagagccgtgatgtatctgagaaattttttgcctctgataaatcattccttggaaacaagagcatgcgttcacatacaaacgaaggagttgagggaaggatttttacacaattcatcgcactgataatccgaaacaaaatttatactgcattacaggaagagaacgaaaaacttgagaagaaacagaattatatgacagttccggcagcagtcggggaacttgagaagattgaaatgacacgccagacggataatgtataccggctggaccatgctgtaacagcaaagcagaaaaaaatcttaaaggcttttgggatgaatgaaggaaacattacttatcgagccggagagatcagtaatacacttaagaaatcaaacattcagaaagaaaggcggtaaatatggcacgtgaaataaacgcagaactactggacactaaaattgaaaaagcacagcaggatctggtgaaagcaaagcatcggtatgatgctgcggcagcaacattaaaagatttattggataagagggatgcacttcgccagaaaaagttattggatgctatagcacagagtggacggagctatgaagaaatcatgcagtacctgcacagtaaatctgaagaggcgtgatcaaatgttaacggaatactattttgcagtcaggtatggagatatcattattcttctctatcatgaagatatgatgtctgtatgggaattattatttaagaacagccagaaggaaaaggcattgaaaagatttttagaatactgctacatgatagatgtaaaagtagcattcgaaggtttgaaaggagaaaaaaccaaagggttaaaggcaactcttaaatttgcgaaagaacatgatatgtgtatgactgaagcacagattcaaggtgccaataacatgtaaatttccagcccgagatgcttttagggctattccaggctggaaattaaggtatatgaagattcatgtgtaatacctcctcaccccttattatatcatacaataacagaaaataacatatataaaaaattgacataaaaaaagcaggttttataaggcctgcaagtactttttacattattcaactgtcaaactcccgtgttacgggaagatatggttctgatcctagtgggatctaataaagcgttagaagcattataagaaaagtttttatggaaaaatattatgtatatgaggcggttcagtaaaaagaccgcctcattttttataacactatcttttgataaaagcaatatttgcagtaaatgtagctcgaatatattagctagatttgtgaattttaaaactcgaatttatgatatatacaaatggtaaaaaaagaaataaaataagcgtataatgctatttttgagcgttctctctgtttcgcagaaatgattttctatttataattgatatacatacagagaggagaaagcagatgatttcgacaaatgaagggtatacaagattagaatatttttcagaggatgttgccgcagacaaaaatagaaaagagtttgatataaaaaatcatacattgtgttatacaaatcagagaccggacttcttgtttattggagactctatcacagaatattgggaattaaatgcatactttaggaactctgatcaattgattataaatagaggaattgcaggggatacgacaaaatatttaaaaaaaagattttatgttgatgcggttcaacttaaaccaaaatattgtattttaggaattgggattaacgattcgatagaattggaaggtgattattggaaaaaactcgaaccggtaccctacagtgaaaaattgaaaatagttaaaagtaatataattgaaattatacaacaagctaaaaaggaaaaaataatgttaattttaacgtcgttgttaccaatcaatattcctatattacgatatgaaagagacagaaaaatgtatataaaagaactaaatgaatggctcatggaaatggcaaagatgaataatttaatttttgtaaattattatgctacaatgacatttccaggtacagataaattacttgatggaattacatacgatggtttacatccaaatgctaaaggatatcaaattatggcaactgtattaaaaaatactttgaaaaaaaatggaattagaatctgaaaggagaagaaacatgatatttgattcaataagtaataaggaaaattataaggaagaaaaagaaatctatcagacattaaattttttggaaaagttaaaaaaatgggatgatgtagaatcgaatgcgattatacagaaggattggatttcggcgaatccagtttcatttttgtccaaagatgaaagcgaatgcatgtatgaagcacatcgaaaacatattgatgtacattatatcatggaaggaattgaaaaaattgcgacagcagatgtaaagaatcttcaagaaaaagttccgtttgataaggataaagatattggattttatgaagggtgcgaatcaggtagttatcttttaaaaacaggagattttatggtttgttttccgagtgacgcacataaagtaggtatgatgaatactgttccaggaatggtaaaaaaagtcgtagtcaaaattagagtggaagaataatggtatgaagaacagctgtaagtaagaaaagaacttatggctgtttttgcttataggagaaatgagtgaaatgtcagttattgataatatacgattaacatttttatatattgaattttattcaatgggaaaaacctgggtatatccagaatcttatattccttataatatatttcgatatattgtaaaaggaaaggctgaattttgtattgacggggaagaaattattgtaaaggaaaaccagatagtatatattccacaaggatgtagaatgtcatgcagagcattaagtgaatcatttgagttttatagtcttcgttttacaacttctgtattttatgaaggtgaagatgttttgaaagagtattatggaataccaagaattattgaaaatgaaggtgaggattattattttaaagagatttgcaaatgggtgaaaaaagattcctgggtaaaaaaatgttttgtgagaggatatctggatcttttaattggtactctgtcaatgcgagtaaataaatttgataaaaatacaggaaaggttacggaaaaaaatgaaaacccagtgcttaaaattgcaaaaaggaaagagcagattgactcaagagtgcaattggtagcagactatgttgtgcttcatccaagagaaaaatatacacctcaaaagatggcagaaatggttgaattaagcaaacaaagattcagcagtttgtttaaggctaatatggggaaaagtccgatggaatatgtgagagaaattcgacttactacagcagcgagagcattacttgtgagcaataaaaatattaacgatattgcatatgaatgcggatatgaagatgcaaattattttattagagaatttaaatcggcctttggatttacgccaaatcaatatagaaagatagcgagagaataaaaatgagcgttaaatgctattattaagcgtgcacttagtagatatgcataaaaataaaggataaaatggaaccatagtaaacaaattgatgtggccgcattgaataagagaaacaagtcaatagaaaaataaatagaagaggaagagcttatgaaaaagaaattagctattttacttgttggaacgatgatagcatcttcaatattagcagggtgtggttccaaaaaaagtgaaccgacaaagaaagaaacatcaggagaactaaagggtgatattaccttttggcattcatttactcaaggacctagaatggaagtgattcagcaaacagcagatcagtttatgaaagataacccgggagtaaaaattaaaattgagactttctcatggggcgatttttatacaaaatggacgacaggattagcatcaggaaatgtaccagacatgagtacggcacttccaggccatgtagttgaaatgatggatgcagatgcgttggaaccagttgatgatttgattgatgacattggaagaaacaagttttcaaaaacagcattatcagaaggaaaaaaagatggaacttgttattcattaccattgtattctcatgcgcaggttatgtggtatagaaaagatttactgcaaaaagctggactttctgtaccaaaaacttgggatgaatttgctgaagcagcaaagacacttacaaaagatggtgtttatggttgttctttcccgtgtggttcaaatgaccttatggcaactagatttttaaacttttatgtaagaagcggtggcggaagtcttttaacagatgatcttaaagcaaatctaactagtgatctggcaatagatggaatcaattactggttagatatttataaaaactgttcgccaaaagattcggtaaattatgcagtattggatcaggcaaatttgttctatcagggaaaaactgcttttgattttaactcaggtttccaaattagcggtgtagaaacaaactcacctgatttggttgatcagatagattgtgcgccacttccgaagattaatgcagatgatccagattatggagctgaaacatcaaatattccaatggttgtttggaaaaactcaaaacatcctgaaatctgtaaggcattcatgaaaaaattatatgaaaaagatacatatataaaattccttgacgcaacgccagtaggaatgcttccttctattagtggaatttctgacacaccggaatataaggaaaatgagactgtacagaaattttcaaatgctgtagatgttatttcagatgcaatggataaaggaactgcaatcggatatgaacatggaccaagtgttcaggcgggacttttaacttcgcagggaatcattgaaagcatgttccaagacattattacaaatggtacagatgtgaaaaaagctgctaaaaaagcagaaaatcaactaaatgatttatttagtacggtacagtaaatgaaagagtaaagccgttcaatttgaacggctttctgaaataaagaaaggtgtatatgatgaaaagaagagcaaaggtagattatgcccgttgggtattcgtacttccagcgctattagttgtgggaatccttttaatttacccaatcttttcaagtttatattatagtatgacaacaaaacatttgattcgtttaacatatgattttataggacttgaaaattataaagcagtgttggcagatccgaacttttttaaagcatttttaaattcagttttgtggacactaggttcattggcaggacaattgattataggttttacaggtgctcttgcaatcaatagagtaaatttcggaaaaggcatttacagaacattaatgattattccatgggcgttcccatccattgttattgcattatcttggaagtggattttaaatggggtatctggatttattcctaacatattggttcaattaggcatttgtaatgaattgccacaatttttgagtgataatagctttgtgtttttgacattaatttttataaatatatggtttggggcaccgatgattatggtaaatgtattatcagcactccaaacaattccgcaggatcaatatgaagcagcccagatcgatggtgcatcaaaagttcagcagttttggtatattacagtaccacatattaaagttgtagttggtttattagtagttcttcgtacaatttgggtatttaataacttcgatattatctatctgcttactggtggtggaccagcaaatgcgacgacgactatgccaatttatgcttataacatgggatggaatacaaaactgttaggtcgttcatctgcagttacgatgctattacttgcattcttgttattagtatgtgttatttactttacgattataggaaaatgggaaaaggaggataagtgatgacgaataaaaaagaaaaagtcgggaatgcgttttgtcatatttatctgattgttttgtctttgatagctgtttttccattggtatgggtacttttgtgctcggtaaaatcatctggagagttaacatcgaatccgacaagatttttcccgaaacattttacattagagaattttacacatgtaattcaggatttagggtttgctaaaaacataggaaatagtttaattattgcaattataacaacaggtattgcgattgtcatttcatctatggcggcatatggaatagtaagattttttccaaaacttggatcgattatgtcgaaagttttagtagcgacatatatgtttccaccgattttgcttgcgattccatactctatggtcatggcaaagcttggcttggtaaacacaagaataggacttattattgtgtatctatcatttagtgtaccatatgctgtttggatgttagtcggattttttaaaacggttccattgggaattgaagaagcagcaaaagtagacggtgcaaataaatttcaaacatttatacagattgtattaccattggtaatgccaggtattgttgcaacagcaatttatacatttatcaatgcatggaatgaattcctgtattcgttaattcttattaatagtacagataaaatgacagtttctgtagcgctcaagtctttacagggggcagaaattttaaattggggagatatgatggcggcatcagctctcgttgttgtaccatccgtaatcttctttatgtttattcaaaataagattgcaggtggaatgacagaaggtgcagtaaaataaaaattggaggattataaaaatgaaaacagtaggatatgcaattgtaggaacaggatattttggagcagaacttggaagaatcatgaaggaacaagaaggagctaaaatcgtcgcagtattagatccagaaaacggacagacaattgcggatgaattggggtgcgacgtagaaacagacttggatacattatatagtagagatgatgtagatgcggtcattgttgcaacaccaaattatttacataaagaaccggttgttaaagcagcagagcatggggtaaatgtattttgtgagaaaccgattgctctttcataccaggattgtgatgacatggtaagagcttgtcaggaacatggagtgatttttatggcaggacatgttatgaactttttccatggcgtaagacatgcgaagaaattgattaacgatggtgttatcggaaaagtactttattgtcattcagcacgaaatggatgggaagaacagcagccaactatttcgtggaaaaagattagagaaaaatcaggaggtcatctgtaccatcatattcatgaactggactgtgtacagtttttgatgggaggaatgccagaagaggttacaatgacaggtggaaatgttgcacatcagggagaagcattcggtgacgaagatgatatgttatttgtaaacatgcagttctctgataatcgttatgcggtattagaatggggatcagcattccactggcctgaacattatgtactgattcagggaactaaaggagctattaaaattgatatgtgtgattgtggcggaacattaaaaatcgatggtaaggatgaacatttcttagtacatgaatcacaggaagaagatgatgaccgtacacgaatctaccacagtactgagatggatggtgctatcatgtatggaaaaccaggtaagaaaccaccaatgtggcttcatagtatcatgaaaaacgagatgaaatatttgaacggaattcttcatggaaaagaagtagacgaagagtttagaccgcttcttacaggtgaagctgcaagagctgcaattgcaactgcagatgcatgtacgagatctagatttgaagataggaaagtgaaactgagcgaaattattggataggagtatatatgaaaaaaagtaaaatattaatttcagcagtgacaatgttttctctgtgcataacacctatgagtgtttatgcacaggtagatccaaatagtaatattgaaaatacaattagtcaaacaaaaagcgcagaaaatttgccaacaccggtacttcaagaaaaagaaatcgaagtttccaatggaacaggctatagtttaaacaatatacaaggagcggagacagtaaaagcgttggaacaaggaacgattgtaatttcatataaggcaacgggagaaaatgcaatacaatctttattcagtgttggaaacggaacaaatggaaatcagaataggcattttcatatttatgtgacaaattctggcggagttggaatggaactgagaaatacggatggagattttaaatatacattagatcgacctgctgctgtaagaggaagttataagggcgaaagagtttccaatacaatagcatttaaagcagataaagaaaataagaaatataaattatttgcagacggagaactaattgctacattagataaagaagcatttaagtttatcagtgatattacgggggtagacaatataatgcttggaggtacattaaggcagggacaggttgcctatccttttgagggaacaattaatagcgttggtgtgtatcaggatgtaatatcagatgatgaattagttcaattaacagggcaaacaacatatgcagataatatcttttatgcgggagatgcaacaaaatcaaattattttagaattccatcactattaacattagattccggtacagtaattgcggcagcagatgcaaggtatggtgggacgcatgattcaaaaagcaaaatcaatacagcatttgcaaaaagtacagatggtggaaatacatggggtgaaccaacattacctatgaaatttgatgattatgtagcaaaaaatattgattggccaagagactctgtaggcaagaatgtacagattcagggaagtgcatcttatatagatcctgtacttttggaagacaaatcaacacatcgtgtttttctttttgcagatttaatgccagccggcattggaagttctaatgcatctgttggttctggatttaaagaaatcaatggcaaaaaatatttgaaattacattggaaagacgattcgtctagtgattacaattattcaattagagaaaatggtattatttatgatgatacaacaaatgcatcaacagaatatagtgtagatggtgaatacaacttgtataagaatggcgaagcactaacctgtaaacaatatgattataattttgaaggaacaagtttattagaaacaccgacagatacagatgtaaatatgaatgtcttttacaaggactctatgtttaaagtatttccaacaaattatctggcaatgaagtactcagatgatgaaggcgataactggtccgatttaaatatagtgagtacatttaaaccagaagaatcaaagtttttggtactgggacctggaattggaaagcaaattacaacaggagagaatgcaggaagattgattgtgccattatattcaaaatcatcggcagaattgggctttatgtatagtgatgatcatggaaatagctggaattatgtcgaggcagaccacaatactggaggagcaaccgcagaagcacagatagtagaaatgccagatggatcattaaaaacatatttaagaacagggtctggatatattgctgaagtaacaagtatagatggaggagaaacatggagtgatagagtaccgcttacagaaattgctaccacttcttatggaacacagttatctgttatcaattattcacaaccaatagatggaaaaccagctattatattatcggcaccgaatgcgacaaacggacgaaaaaacggaaaaatatggatcggattaattaatgaaacagggcaatctggagtaaataaatattctgtagaatggaaatattgttattctgtagatacaccgcaaatgggttattcctattcatgcttaacagaacttccggatggtaaggttggacttttatatgagaaatatgattcatggtcaagaaatgaactacatttgaaaaatatattaaaatatgaaaaattcacgattgacgaattgaaggttcagccataaaaggaataatgtactttgaataaataaaatatgcggttgacaaaaataaaaggtgaaccgcatattttcattataagaattgcttaaatgaaattaaatattagaacgtaatattataaatagtatttgtaaaaggagtaaaaaatatgagaaatcttgaaaagtataaaggtgtgattccagcgttttatgcatgttatgacaatgagggaaatgtaagtccagaaggagtacagtcactgacaaaatatttcgtagaaaaaggtgtaaaaggtgtatatgttaacggatcttcgggagaatgtatctaccagagcgtagaagatcgtaagatcatccttgagaacgttatgaaagcagcagaaggaaaacttacagttattgcacacgttgcatgcaataacacaaaagacagccaggaacttgcaagacatgcagagagccttggagttgatgctattgcagcaattccaccgatctatttccacctgccagagtatgcaatcgctcagtactggaatgacattagtgcggcagcaccaaacacagactttgtaatctataatattccgcagcttgcaggagttgctcttacacagggactttttgcagagatgagaaagaatccaaacgtaatcggtgttaagaactcttctatgccagtacaggatatccagatgttcaaacaggcagcaggtcctgactatatcattttcaatggaccggatgagcagttcatgagcggacgtgtcatcggagctgaaggagcaatcggtggtacatacggagttatgccagagttatatctgaagttagatgagtatgtaagggctggaaagatggaagaagcaagagaaatccagtatgcatgtgatgaaatcatctataaaatgtgttctgcacatggaaatatgtatgcagtgattaaagcaattttaaaaattaatgagggtcttgaacttggtggagtaaaggaacctttacctgggttaattgacgaagattccgatattgtaaaaaaagctgcacaaatgatttgtgatgctaagaagaaatatttgtaagtataagaaaataaatttttgaattcttggcgaataatcaaaagggtaaaccgagcaacggcttaccctttttgaatatatataatatgacacaaaaacaaaaagtaatatatttgaaaggaaaggttcataagatgaaaaaatatattagtatcgacattggaggaaccgcgattaaatatggaattatctgtgaaaatgctgaaatcatgatgaaggaaaccatgaaaacagaagctgaaaaaggtggttctgcaattttggaaaaagtttttgtaattgtagaaaaactacaaggacgaattcaggaaaaagcttctggaatttgcatttcaacggcaggaatggttaatacagaacaaggtgctattttttattcggcaccattaattccaaactatacaggaatgcagtttaaaaagctattagaagataaatttaaaattccttgtgaagtagaaaatgatgtaaattgtgcaggacttgctgaatatcgttcaggtgcagcaaaaggaagtcatgtggcactaattcttacaattgggacgggaattggtgggagcattataatggatggtgaagtgtatcatggattcagcaacagtgcatgtgaagttggatatatgcatatgaatgatagtgattttcaaacacttggagccgcaagtattctgacaaaaaaagtttctgaatggaaaggggaaacagaaaagaaatgggatggatatcatatttttgaagaggcaaaaaaaggagacaagctttgtcttttggcaattgatgaaatggtggatattttaggagaaggaatagcaaatatttgctacgtgattaatccagaagttgtagtacttggagggggaatcatggctcaggaacaatttttaaaagagagagtcgaatgtgcagtgaaaaggtatttagtatcaagtattgaggaacatacaaaaattgtatttgcaaaacatcagaatgatgcaggaatgttaggagcattttatcatttctgtagtttgcattaaaagggcaggattatattatggaatattatgtaaaatcagtaatatcgattatcgaatcaaattatcataaattgacgtcggcagaaaaaacagttgcagatttttttattcataataatcagaacacagatttttctagtagtcatattgcagaattactttatacatcaaaagccacactgtcaagatttgctaaaaaaataggatatcgaggttatcaagagttcatttatcaatacgagaacacatttgaggaaaaagaagagaaaattactggaaatacaaaaatagttttgaatgcttatcaagaagtattaaataaaacatataatttagtggatgaggctcaaattgggagaattgtgggatatctgaataaagcagaccgtgtattagtatgtggttgtggtagttcaggtctttcagcaaaagagatggaaattcgttttatgcgaattggtatagatgttgattcgatgacagattcagatatgataaagatggcatctgtttttcagaatagaagaagtcttatatttggttttagtataagtggagaaagagaagaagttacctatttattgcgggaagcgtataacaaaggtgctaaaacggttttatttaccacaaataatggaaaaaagttttctgagtactattcggaggtagtagcactttcctctttaagacatttgaactatggtaatgtgatttcgccacaatttccgatattgattatactcgatattatttatgcttattatgtagagcagaataagtatatccgagaaggaatgcatgatagcacattatgcgcattggaagaataatgaacaaataattaaatgattaatttggtgacacatcaaaactgcaagaaataattatctttatgtgtgtcagcgaagagttatgaattttgcaataaacaaagaaagactaacccaatttggattagtctcaatgatagattactacaccaagaggtgtgttacttgttaagttgattgaaccgccgtatacggaaccgtacgtcagactgtctaacgattagcaaaaatgttataattaaatcacaagagatcgaatcgaggggattaattatggcatatattgttggaatagatagaaatcagacaagaatggttactacatcattagatgcgcttatagatgaagataattccgtgcgtgtaatcgatgcatatgttgattccttagacttaattgaattaggttttaaagaatacagcggaaccaatagaggtcaagctccatatcgccgttcagatttgttaaagcttcatatttatggttatcttaataaaatcagatccagtcgttccttagaaattgaatgtaagcggaatcttgaactcatgtggctgattaatgcaatcacgccagatcacggaactattgctggctttgtcaagaacaatcgtaaagcctttcatgtaacattacgaaacttaactctcattcttaaaggttggggattaattgacggaaaacttatagctatagatgggacaaaaatccgagcacaaaacagtaagcacaactgcattactaagagcggcttagataaaaagattgcttatgctgatgaacagatcaacgcatatcttatggcacttgaaaaagactcgctcttgtagcagttgcaaatataaaaataaatgtacctcatccaaaagcggaagaacgcttcaaagatgggagcatgaagctgtattagaagctgttcatgaaaaaacttggagccggaatgaaacctataaacaaagaagatgcatagttgagcacccttttgggactgtgaaaagatctttaggctatagctttttcctgcgaaagagaatagaaaacgtagatgcggaagcatcgtctatgtttatcgcttataaccttaagcgattattcgctgtgttttcaacacaggaattaatagcaaaattcagataaaaagcaaaacgatatgtagaaatatgtaaacggtagaacataagtacctttcatactcgaatctattatggcataattacactcatcaaagatagtcagtcaaaaaagttaagtactcaacttttttgaccggctatactcaggaggtgagttatgactacacaaaccagtcttgtagcggaacaggtcagacttcaacagtgggcagaacaggtgcgggattgtaagaatcgtccaagaggaatggacgttgaaacatggtgtgctcaaaacaatattacaaaagccaattattattatcgactccggcgtgttcgaaaagcatgcttagatcaaatgcagacagaacaagcagattttatcgaactgccaatgccatcagaaaaaaacatatctgcagatactgaaaatgtttcggattccattccggcaatacgcattaaaacgaaagaaggagtttcttttgaagtattttcgaatgtttctacggaagtattgaaatatcttatagaggtggtcattcatgctgaatgatggtaaacggtagaacataagtacctttacagaaatatagtatctacatatcgttatatctgaaatattaagtgaaaagttaccgcataagtgtcaggagtctgaacaatcataatgaaaatggattcgttagacagtctgacgtacggtggtgtgagaggtcgggaaaatttatttaattttccctcctactcgatttatataagaaacatacattctattaatagagcataatcagcagatagcataatcagcagatgaaaggaggatgagaagaatactgtaatgttcgaataaaaaataatggaggaatacaatatgaaaggacaaatgaaagtcaaaaaacttaatgatacgggattgtatatctcagaaatggactgggataacacctatatttgtaaagagaatccaatcggaaattttgtaatggtaatagaaccattatcagattttgatggggaatatgtattattattcggttgagtttgtaaaataagaatagcaaaaagagagaagaggatgccatggaatcgttgatttgatgattccgtggcatcctcttttggagcggaaactggatttatgatattgtggattttagaacttgtttcttatctttcggtactctcttggggaatatccttttagcttgtggaaaagccggctgaaataaagctgattatcatacccaacgattttagaaatttcattgatggaataggttgttgtttcaagtaacatctgggcattgttaattcggattcccacaataaactgcattggtgtagaacctgtgtattttttgaagtttcggataaaccagctgacactcattccacgtgaggcagcataatcatctatgctaatattctggttataattttcactgaaaaaggtaactgcgttatccatctcgtgatccaggtattcatttttcgagatatgttccctggtcagttcccgatgaaagatgataagaagatgacggagcagaaggacaagcatttcctcataattatcttggcaacgctgaagctcgatgataatacgcttgaaaatctgttcgtattccatagaggttccgacctgaaatacatgctctttatccgggaatccatattgccgtaggatattttttacattgttgcctgtaaaatgaatccagtatacttctgtcttatcttttccataatattcatatttctgaagttccttcggtctgtacagcacaatattaccggcggggacaatcgtttcgttatccatattgtcaaaatgaaaatgcccacaaccagcagtgatatagataatctgataatccaggcgtccccttggacggtaggttggtaactttggatggctggaaaggcggtaagtaccgcaacttcctacaaccagtgggcgacttttgtctttgaaatccatatgggagtggtttaaataaccggtattcatatacatatggcagcacctcttttccttttttttgttattgtatcatttagtgcatattttgtctaatccaattcatagacatgttttgcagattaggataagatatatatagcaaaacagagaaacgtaaacataaaagtaaaagacaaggtttgctgtgaaaaacaaagtgcaaaaaaatgtatatgtattaaaggagagttatttatgattgtaccacgttattatgaggatttaagcgtactgcacgaaaacacaatgccagctagagcctattatattccggcatccaaaagaatggataacctggtggagcacagggaagagtcagaccgaatgcagttattgaacggaacttggaagttccagtattttaacagtatctatgatgttcaggaatccttctttgagaaagattatgatacagaaaattttgatgagattcaggttccgagtgtatggcagatggcaggatatgatacacatcagtatacaaacatcaggtatccgttcccatttgatccaccgtatgtaccacaggatattccatgtggaacatatgcacatacctttgtttatcacaaagatgaaaatgcaccaaaagctttcttgaattttgaaggagtagacagttgcttttatgtatggatcaatggctcttatgtagggtatagccaggtttctcatatgaccagtgagtttgatatcaccgatctccttcgggacggagagaacagcatagcggttctggtcatgaagtggtgtgatggttcttatttggaagatcaggacaaattccgtatgagtggtattttccgggatgtgtacattttgaaacgcccaaaacatgcaattagtgattatcatattaaaacaagaattgaagatatgcttgcgaaagtagaaattgaaatgaaattctactctccgttaaatgtaaaaatttcgattgaagatagaaacggagcagttgtagcactaggaagtattgctgaagaaggaacagctgtattagaaatcgcaagtccggaactttggaatacagaaaatccatatctatataaactgattcttgaaacagagaatgaagtaattgtagatcacattgcattaagaaagatagagattaaagaccaggttatttatttaaatggacagaagattaaattccgtggtgtcaatcgacatgattctgatccggttactggatttacaatcaatccggaacagattacaaccgatcttacgttaatgaagcagcataattttaatgcgatccgttccagccactatccgaacgcaccatttttctatgaaatgtgtgacaagtatggattcatggtaatagatgaagcagatattgaagctcatggtccatttatgatctacagaaaagaagacaccgattacaatcggttcaaacgatggaatgagatgattgcagatgatccggcatgggaagaggcaatcgttgatcgcgtaaaactcatggtggaacgtgacaaaaaccgtttctgtattgttatgtggtcaatgggaaatgagagtgcttatggctgcaactttgaaaaagcactggaatggacaaagaattttgatccagaccgtatcacacaatatgagagtgcaagataccgtaattatgatgaaacatatgattacagtaatctggatgtgtacagccggatgtacccggcactttccgaaattcaggaatatctggataaagatggaagcaaaccattccttttggtagagtactgtcacagcatgggaaacggacctggagattttgaagattacttccagatgattcaggataatgataaaatgtgcggcggctttgtctgggaatggtgtgaccatgcgattgctcatggaactgctgagaatggaaagactatatatgcttatgggggcgaccatggcgaagaaattcatgatggcaacttctgtatggatggattagtatatccggacagaacggtacatacaggacttttggaatacaagaatgtttatcgcccggcaagggttatttcctatgacaaagaaagcggagaactggtgcttcataactacatggattttgatgacttgaaagattatgtgaagatcagttatgaactgacgcaggacgggcttgtaatcagcaaaggtaaacttccagaagtttcagcagcaccacacagtgaaggaaaaataaaccttaaaatcaatgtgccagagagtggaaaatgttatttaaaatttatttaccatctgaaaaaggaattgccactgttggatgaagaccatattcttggattcgatgaaattgaggtaagcaaagacggtgcaaaatgtaaacttgctgagaaatggctgcaaaaaacagcagtggactctgagttacaggtaaatgaaaatgatacacagatccatatcaaggggcgtgaatttgcttataccatagacaaacgtactgcactctttacagagatgaaattcgcagggcgggaatacttgaaccatccgatggaattaaatatttggagagctccaacagataacgatatgtacatcaagtctgaatggaagaaagcccattatgataaagcttatacaagagcttacacgacagaggtcgtgcagggaaagcatggtgtgaaaattacaagccatgcatccgttgtggcagagacagtacagaagattcttgatgtgacgatcacatggaaaatagaagctgctggaaagattgatgcagatattgcagtaacaaaagatgatgaattcccggatttgccaagatttggtgtgaggatgttcctggataaaaaactttcagctgcacgatactttggaatgggaccacaggaaagctattgtgacaaacatcaggctgcgagccacggtttgtatcaggcaaatgtagatgatttgcatgaggattatattcgcccacaggaaaatggaagccattatgattgtgaatatgtagagcttaacaacagccgatatggaattgtggtctctgcggaaaatgccttctcattcaatgcttcttattatacgcaggaagaacttgaggagaaaacgcataattatgaactgacagaatcagatagtgtagtattttgtgttgactatgcactaaatggcattggttctaacagttgtggtccagttgtattggagcagtaccgatttgatgatgtattattccggttccagtttacactgataccgtatataaagggataataaagtttcatgtaacccgtaaacaaggaaagagagtctgattgttatgtaaagtccggatatacagagcaatcagacaaaaacagagaaaaaactagaattagacatcatactctgttagacattttgaaattctaagtgcgatgaagatgaggagcaaagaaattcgatggaagaaaaaaagtatttgaaatggtataacaaaattggatatggatcaggcgatattgcaggtaatgtagtctatgcgttcctgacatcttttatgatggtctatttgacggactcagtaggacttgctgcaggtgtcgtaggtagcctgattgccgtatcaaaactatttgatggttttacggatatattttttggatcaatgattgacaaaacacacagtaaaatgggaaaagcgaaaccctggatgctatatggatatattggttgtgccattacgctggtctgctgttttgcagtaccagtcagcttgggaacaacggctaaatatgcatggttctttatctcttacacattgttaaatggtgtgttttatacagcaaacaatattgcttattcagcacttacgtcactgattacaaagaacagcaaagagcgtgtgcagatgggatcttaccgttttatttttgcgttttcaacaagtcttctgattcaggcaattacagttggatttgtagataaatgtggtggagatgctgcagcatggagaacggttgctattatctatgcaatcattggtcttgtcataaatacgatttcagcactttctgttaaggaacttccggaggaagaacttaacgaaggagaagtaaaggctgataatgaaaagtacggaatggtacaggcattcaagcttcttgtcaaaaacaaatattacatgatgatttgtggaacatatattttacagcagttatatggtgccatgattggagctggcatttattacatgacatgggtactgaaaaataagaatttgtttggacaatttgcatgggcagtaaatattccactgattattgccctgattttcacaccgacattagttggtaagtggaaaggtatgtataaactgaacttaagaggttatgtcttagcagtcattggtagagcacttgttgttgttgcaggatatatgggcagtgttacgctgatgatggcatttacagctcttgcagccttaggtcagggaccatggcagggagatatgaatgcagttatcgcatcctgctctgaatacacttatcttacacagggaaagagaattgacggaacgatgtactcttgtacttctcttggcgtaaaaatcggtggaggtattggaaccgctgttgttggatggctgcttgagttcagtggatatatcggaacaaatgcaactcagccgcagtctgcacttgatatgatgcagtttatgtatctttggcttccgttaatctttgatgtattgattatgtttgtactttcaagaatgaatgtagaagatgcaaataaaaaactgaaagcagaaaaaggaattgctgcagatgaagtaacagatgcatcagacataaattagaattgacaggagaaagcgttgtctggtcgttgctcgatgagacaacgcttttttctatatataaagtgatagaactgtattttgaaaataaaaaagaaccacttcatttttgtgaaatggccttaagaaaatattcagttttcacaaaatagtccttttagtatttatacatggtaaggatgctcaaaatattcaatgtagaatactaaaaggtcattcagatatttttttaggttgctcatttgcaattcctcctttccttatttacaagttgattataagataggtgtaaaaggattgcttgccaaatcgaaagaagatatagacaaatgttgcaaaggggagtatttcatgcagttaaaatatgttgacacaaaagaggagatcatagcaataaataggaagtcaaaacatattgaaccacatcttcataatgcactggagatcgtttgtgtaacaagtggagcattagaacttggtgtcggacaggaactataccatatggaaaaaggagatataggctttgtatttccagatgttattcatcactatcaggtactgacacccggtgtaaataaagcgacttatctgatggcatcgccatttacgatagccaaatttgcagatatcatgcaatccatggctcctgaatacccaatcatcaaagcggaaaaggttgaaccggaggtatatagggttataaatgcaattttagagacagaacagtcggatattactgttgcacaggcatatcttcaaattgtgttggcacgctgcataggaaaattaaatttggtagaaaagagtaatgtggggagcaatgatcttatttaccagacagtttcctatatatcagcaaattttaagaagaaattttcgctggaagagatggcaaaagatctgggggtgagcaaatatgttttatccagactcttttccaaaacatttcatagaaactttaatcaatatcttaacgatgtaaggctgaactatgcatgccagcgtttggaaaatacgagtgattctattacaaaaatttgtctggatagtggatttgaaagtcagagaacatttaaccgagtatttaaagaaagatataaaatatcaccgagtgattatcggagtacatgtctgaaagatatgttgtcataacatatagattaataaattcaataaaaatctgattatcagtctgaaataagtatctctgggtgttatttataatatggggtagtggttaattattatgtcatgtatgaatggggaagaaacaaacggagaacttcttcagaaaaagaagtaaatacagcagttaaggacttcggaagtagaagaacagttcgagtatatgtatcggctgttctttttttattttttggcgttaaaacggtaatgttttcttgtgtacagtagagtgctatagtataataaaactagtttttttgcataagtattaaagctataatatggaaatcggcaaaccagatgaaagtctgggacgcaaagctacagggcctgtaaaatggcagccagttgcatgaaatgaggtgcactgtctgtttggcagtgcttttttatggtagagcacttgaataagtaatacagaagctgtttggaaaaatattgtgaaaaatagcggggaggttattgataattaatgaatgtaaaattaaaatctggaagcaagcaactgtagcctagaggaggggagaaagatgaagaagtgcaaattagtacagaatataatgaatttcaaattttgttacattatattttgcacaattatatgttttattgttttatccgttcctacatttgccaaagaaaactctgacaatgttatccgggtaggatcttttgaagaaacttataataccgtcaatgaaaagggagaaagaagcggctatggttatgagtatcttcaagatattgcaggttatgcaggttggacatataaatacataacaagtgattggaaaaactgctttacacagttggaaaatggagagattgatattcttggtggcatttcctatacagacgaacgtgctgaaaatatgcttttttccgatatgcctatgggggaagagaaatattacatctatacggatgcatccaatatggatcttacagcaggaaatttggattcttttgagggaaaaaatattggtgtgtttaaagataatataacggaggatgtgcttaacgaatgggagttaaagtatggtctgcatacgcagcatgtcaatgtttctaataccgcagaagttatggacaaactgtcgaaacatgaaatggactgcttcgtttcggtagaagaaccccgttgggaagaatcggagatttcgccgattacaagtattggagagacagaaatctatttcgctataaatccagaacgtccggatatcaaagaagcactggatagtgctatgcgcggaatcaaggatgacaacccattttacacagatgatctctacaggcgttatctttctgcacagagcagctcgtttctttcaaaagaagaaagggagtggatcgggcagcatggagcaatcaggatagggtatctgaatcaggatggaggtatcagtagtgtagatttatcaacaggtaaattgacaggtgttatcacagattatgtggatcttgcagaaaattgtctgcaaggtcagactctggaatttgaactaaatggatatgatacaagaagtgaactgcttcaggcattgcaggatggaaatatagacctgatttttcatgcaaaccagaatccatactttgcagaaacaaatggatttgctttgtcggatacgctattgactctcaatatggcagcaattacggcaaaggattcttttgatgaaaataaagagaatatagttgccgttgaaaaagataattttgtattgaaagcatatctttcatacaattatccacaatgggaggttatggaatatgagacatcagatgcagcagtaaaagcaatgcagaaaggggaggcagattgtattgtaagcaattcaggtactgtttcagactatttgaaaaataataagcttcatagcgttttcctgacaaaagaggctgatgtttcatttgctgttcggcagggagaaccggttcttttgtccattctgaataaaacactgacatctatgcctataactcaattttcaggtgcagtagtttcgtataatgcttccgcacgaaaagttacagcgaaggattttattcaggacaatttactggctgtctcactcatagctggaatctctattttgattgtcctgtgtataattcttgattctttgaaaaaatcaaaacgtgcagaagaaaaatccaagaagtctgctgagcaggcattgaagctgaatcaggaactggaagaaaaacagcaggaattacaaaatgcacttgtagaagcacagagtgccaataaggctaagacttcctttttaaataacatgtctcatgacatcaggacaccgatcaatggcattatgggcatgcttacaattcttaaaaaaagcggaaatgatggtgagcgggcaaaagattgcctgaataaaataaatgagtcttcgaaactgctattatcattggtaaatgatgttttggatatggcaaagttagaatcggataccgtggtttttagtgatgaatccatcaatctggatcaggtatgtcaggaaatcacggagtcactatcttttcaggcagaagaaaaaggacttcatgttataggagaacatgatgattacagtggtatatatgtttggagcaatgcagttcatctgaaaaaaatattgatgaatctgtttacaaacagtatgaagtacaataaggtgaatggttctatttacatgagtatgagaacgattgaaagatcagaagatcacatgacatgtgaatttaaaataaaagataatggaattggaatgtcagaagaatttataaaaaatgaattgtttactccatttgtacaggcagataattccccacgttctgattataatgggacaggtctgggaatgcctattgcgaaacaacttgtagaaaagatgggtggaaccataacagttgaaagcaagctgggtgaaggaagctgttttactgtaatacttccatttaaaattgatacgaatgcacggccggaagaaaaagaagattttgatgcagatatatcaggtgtccggatattattggttgaagataatgagctgaatgcggaaatagcagaatttatgctgacggaaaatggggctaaagtagaaacagtgaaaaatgggttagaagctgttcagcactttgaagcctgcgaatcaggaacatacgatgttattttaatggatgtcatgatgccggtgatggatgggcttactgccacaaaaacaataagatccctggaacggcaggatgcaaaaacaatccctattattgctatgactgcaaatgcatttagggaagatgcagaaaagtgtatggaagcaggaatgaacgcacatctggcaaagccattagatgataaaacaatcaagcagactatatgcgaagaattgggaagcagtaaggacaggtgaaaatttattaaaccaagaggttgacaaggagatgtatagagaaatatatttgacagacaggagatttaatatgatttcgagagcaaagaaatatgtggcagtgttactggcttttgtatgcgtgtgtatgatattttctcccctgactgcatatgcggccgaggacagttcgcagcatgaaactgtcaaagtcggtttctttgccatggatggttatatgacaaccagggaaatccgtactctgaggaataacaggaaagcaaatattccaatcgttgccatgaccgcaaacgcattcgaagaagataaaaagaaggcatttaaagcaggtatgaatgctcatattgcaaaaccaattgatataaatacaatacttgctgtttttgaccaggtgtttggtgtatagaagttgttgtttcccaattggagcatatgtaagtagcaagaagacaggcggcaaataattataaaatggggaaaagtgatatggaagaatacagagatgataaaaaaagtaaattgtattacatggatgaaatccttcataagatttcttccatgagtcaggcagagaatgaaaaacaactggatgacattacgccatctatactgaagagcgttggaaaatatacagcagcagacagagcgtatatttttgaatggagttcagaaaaaaaagaaagttttaaaaatacatttgaatggtgtgcctcgggaatcaaaccgcagatacagaatctgcagaaagttcctgtctgcctgatgcagaactgggtggaaacatttatccagaagaaaaatatcatcatttatgacctggaagaaatagcagaagaaaccccacaggaatatgaaattttaaagcctcagaatattcatgctctgattgctgtgccgatttatacaaatcataaatttataggcttcattggattggataacccggatctgaatcagaatatggtgtccatgaatctgttatctgatgtggggtgccatatgggaagtgtccgtgaaaacctgagaatgatgaaggcacttgaggatgcactggaaactgcaaatctgaatggagaaatcattgattccatcagtaaattatactggctgatctaccgaatgaatctggaaacaggaacttatgaagaaatatctgccggcaacgagatgcataaacttacaggcaagcatggaaaaacggaagaagctttccagcatgctatcaatacaattgttgatggggagcatcaggaaatgatgaaaaagttccttgatacatcgactctggctgacaggctgaaagacacggaaagtattgcggtcgaataccgggcacaaagtggatcctggcatctggcaagatttattgtaaaaaaacggaacccatctggtaaggttacaaatgttctgtatgttgtccggcagattgataaagaaaaacaggttgaaattacttataagcaggaactgataaaaaagaacaggattttgtcaggactgagccgtgattatacgacagcttttgttttgaatctggatacggatgagtatgagtttgtatttaatcaggagacaaatcatgctcagaaacatgaagagttcaaagcattttcagattatgtggatgcctatgcttctgcatttgcacttccggaatttcgtgacgtaatgcgtcgggaactggacagtaatgtgattaaaaagcattttgaaacagaagacgaatatcatttttcttttgagacgtcaccaaatgcagcaggtttgtcctgttttcaggcacatattgtaaaagagtacgaggaaggcagccattttgcgttccttggtttccgaagtatagatgagatcgtacagaaagagcgtttttataaagattctttgcaaaaagtaaaccaggaacttaagcatcagctggacatgatcacatctgcactgccgggtggtgtgaaaatcagcaatgatgatccggaatattcttttaagtatgtttcagagcattttgcacagatgctgggatatgatactccggaggaattgatggaagcttctggagggacgattgttgacctggcgcatccggacgatctggaacatggaattgcacaggcgttggagcagtatagtaaagcggatcattatgaaatcacataccgaatgaaatgcaaaaatggatcctggaaatatattgaggacaggggacacaaaatccgcaaaccggatggaatgatcgaacactggaatctgattctggaccaaaatgaactggtggaaaaaaccattgccctggagagcgaaaaaaaagcaaaccagagtaaatcagatttcctctccagaatgtcccatgatatgcggacaccattgaatggaattatcgggcttatggatatctgcatgaagcacccggaggacagaacactggtggattccagccgtcttaaggcaagagtagcggcagaccatctgttgtcactgatcaatgacacactggaaatgagtaaactggaaaatgaagaaacaaaaatttcgaaagaagatttttatctgccggatctgcttcatgaggtggaaaccattgcacagatgatggcagataaagagtgtattacgattcattttatggatgatccttattcgattccatatccgaatcttaccggaagctccctgcgtgtaaaacagatatttttaaatctgattacaaacagtattaaatacaaccgtaaaaatggctcagtggattgcttcttgaaagaagagaagcaatccgataatagagtgttggtagatgtgactataaaagatacgggaatcggaatgtcagaggatttcctgaagaatatatttcagccatttgttcaggctgatcagggcgccagatcacactataaaggtaccggacttggaatggcgattgtaaaagagctgcttgatcgtatggatggaaccattcagattgacagtgtggaaaatcagggcactttcatacatgtggtcataccttttgaaatagcagaagaacctgcagttgtacaggaaatgtctgaattaccaaagaaaaatctgtccgggtgccgtattctattggcagaggataacgagcttaacagggaaattgcggcattccttctgaaagatgagggaatttccgtcacagaggcggaagatggacagcaggcagtggaatgtttcctaaaaatgccggaaggatattacgatgcggttctaatggatatcatgatgcctgtgatggacggatatcaggcagccagggcgattcgtggcagtggaaagaaagatgcagaaatgattccaatcattgccataacagccaatgcttttgctgaagataaaagaaagacgatggaggcagggatggatgcacacctgtcaaaacctttaaatgtacaggaactgatggatacaatccgaaaattctgtgctgataagcagatatgtcagtgaccgagaagagaataacagagggatagcagaatgaaaaaggacagcgaactatataaaaaaataagagtacattgctatattgttggattgattgcttttctgacagcattgattgttggcgtttttctgcttcataatttggaaaaggatgaaaagacaaccggaaaatatatggtgcagattactgagaaaagagtcagggcaagactggatcagtatagcatgctctctgctcttttgggaaattatatcagtgcaggagagaatctggatgagaatacattttctgaactggcagaaaagattcctaatgaagatggagtgataaaggcatttgaactggcacctgaagggattgttacagacatttatccgaaagagggaaatgagggggcttttggactggatatgctgcaggaacatgaacggaaaaaggatgcaattctggcaagggatagcgggaaatatacgcttggaggaccataccagttaaagcagggaggaacaggagcattgctttttaatccggtttatcaggacaataattcagaacagggtgagttctggggctttgtgattctggtgattgactgggatcgtttcattagagagataaatcttgattatttaagcgatgcagatttctgttacagaatttggacatatgacagaagcagcagcgacaagattattttagcagagagccaggataatatgtcggataatattctgacagtagaatgtgcagttcccaataacacatggtattttgatattataccctcagagggatggagtccacgttcttactggattatgtgtattgtcatttcttatgtattctcattattgattgctacagtattttatttaatatccagtaaaaaacacagggaaagacaatatgaagcagaactggaaaaagctgctgagcaggcgaaaaatgccaatgaggcaaaaacaagatttttatttaacatgagtcatgatatccggactccgatgaatgcaattgtaggtttttccggtttgttggagaagaatctgcaaaatgaaagaaaggcaaaagaatatctggaaaagatacagtcttccagtaatcttttgctgagaatcatcaatcaggttctggagatggcccggattgaaagtggtactgcggtattgcagttaaaagctgaagatatggatgcattatttcacagagtaaatacagtgtttgaagaggatgtcagaaagaagaacctgcagtatcatgctgttttagatgtaagacatcattatgttgtctgtgatcagacaaagttacaggagatcatgctgaatattatcagcaatgctataaagtataccccggagggacattcaatctatgtagaagtacatgaggcggtatcagagaatccttcaaagatacgctatattttttcatgtgaagatacgggcattggtatgagtgaagaatatcttccacatatctatgaagaattttccagagaacatagtacaacagaaaacaaagtgccgggaaccgggttgggacttcctattatcaaatctatgatagagctgatgggtggaagtattcaggtagaaagcagacagggtattggaacaaaatttacgatagatctttcttttgacatagcattgaaagaagaggtatatggaagtgaggataccatagagtcatctgcaattcatacaataaaagggaaaagaattctccttgtagaagataatgagctgaatgcggaaatagcaaagacagttctcgaagatgtcggagcgttaattaccagagcggagaatggacagcaggcactggaactatttaaagagaaaccggcaggaacatttgatgtaattttgatggatctgatgatgcctgttatggatggatatacagctacgagaaaaatcagggaattagaacgttcagatgcaaaaacagtaccgattatagctatgacagcaaatgcattccaggaagatgctgaaaagtgcattgccgtgggtatgaacgctcatttggcgaaacctttggatattgaaaagatgaaaaagactattaaaagtatttgttcctaatataggcggaaattaaggaaatattgaaatccttgtacagagaaaaagatagattaaatagttatgaaaatcaaataccaatcgactatgcatgcggatgggcattatccttcaatgatatgtcgtgtacaatgcagatgttattggatgatgcagatgcttatatgtataaaaataaacagttatgcaagaaatataaaggaaacagaaaatatgaataaaagacaaaaaatactgattgtcgatgatgcaaagttcaacagggatatattgaaagaatttcttggagaaacctatgattatctggaagctgaaaatggaaatcaggcagtccagattatggaagagaatccgggaatcgatctgatgcttttagacatcaacatgccacagatggatggatttgaagtcctgaaatggatgaaactaagccaatgcattgaagaaactcctgtaattatgatatcttcggaagaatctgttgagactatgcgtaaagcatatgagatgggaatcacagattatattacacggccatttgactctgttatcgtaaaaaagagagttcaaaatactttggggctatatgcaaatcaaaagcgcctgatcaatgtggtcgttgatcaggtttatgaaaaagaagaaaataataatattatgatcaggattctgagcaatgtattaggatcacgcaacagtgagagcagcgaacatattttacatatccggactgcgacggaaatgatgctgaggcaactggtaaaaacaacggatgcatatcatctgacggagactgatattgctataattacaactgcatcttcgcttcatgatattggtaaaatacgcattccggaagaaatactgaataaacccggaagactgaccgatgaagaatttaaaattatgaaaacccatagtgagattggagcatccatgatccgggacatgcattttttgcaaaatcatccactggtgcataccgcatgggaaatctgcagatggcatcatgaaagatgggatggaaatgggtatccggatggcctgaaaggagaagaaataccaatctctgcacaggtggtgtctattgtggatgtttatgatgctcttaccagtgaaagatgttataagaaagcatttgatcatgatacagcaatcaagatgatcctggacgggcaatgcggacagtttaatccgatccttctcaagtgtttggaagaattgagccttcagttttcaaaaatgctcagcaaagagatggatagtaataaatattattatgaggcgcagagactttcgaatgaaatactcagtgaaaaatctttgccgaacaaaaactattcgcagaatgtcgttaaaattatgcaggaaaagatagattttttcagatcgcacagtggcaaaaattctatcgagtataatgcaatttcagggcagctaatcataataaacgaggagcagcagatactttgtcagagagatgatcctaaatttgatatattcaatgtgttcgaagtgagcatggaagacattcaacacattagatttttgttaaatcagacatctgtacaaaataatgaaatcacattgcagataaaagcgaaggtgaagaacgacagtcagatgtatcatctgaaactgcatacgttgtggtcgcctttaaagaaagatggatatataggaattgttggatattttgacactgtaaaatagaaaaatgcaaagcagtggagggaatgcggcatattctgttatggcaaacctttgttttatagaaaagaataaaatgaataaatcagtattgcaaagggatcgttaacagcgggaaggttaaggattttgaaaatttcctgagggaaaatggaattgaatataatttgtatgattgtgaggttgatggtaaaaaggctatatattgtcattttgataataaagatgcggaattgtattccatttgaaaaatagtatgaaatgcgggaatatagaaggcagttatgaatagctgccttcttgctatgtaaagaagcactggttttgattgccatgcatttgaaagaagctgccactggcagcttctcttgcgtttttacagaaaatcctgacaagataccagaagatcaatcttcttccactgtgtctcttcatcaatacagttgccctcttcaacggaagcaaagccacattgcggagaaagtgcgatctgctctccgactacggagcgggcttcggcataacgttttttaagaaaatcatgatcttccagaatcgggttcttggtagagattaatcctgcgacaaagatagcatccttatctttcaggacagaccatggagcaaaggaaccggaacgggcatcgtcgtattctacgaagaatgcgtcatatggaatttcagcgattaccggggcaacggaatcgtaaaatccatggaacagaggatttcccttgaagtttcctttacagaaatgtgttgcaataaagaaatcttccggtttgtgttccagagcttttgttgatacaagctggaaccagttcagaatctgtccttttgtatatccaagagcagttatctttttctggaagttctcatcgatgagataagtccatgatgtatcatcaatctgaagataacggcagccatggtcatagaaatctaaaattgcatcctgataagcttttgcaatatcatcgatcagtgcatggatctctattccgtaataaggtgtctctttattaccaagctgaaggaagtgatcaatcaggatcatattcggaccggaaatacattttttagccgtaataccgtcatatttttgtgccagagaatgaagatagtcccacgcacgaagctccgggtgtgccttggtcttatcatagaagaacttaccggtaacggttccaagctcaatttcattactggttccattgatttcttttgtgaaatgaatggtatcgaatccatcaaattctttgagccagtccaaatgccaccacctgcggcggaattctccgtctgttacatatttcaaaccgtgtgccacttccttttctaccagtgatgcgattgcaagatcttcggcttgtgttaattcttcttttgaaatcttaccgtctttataagctttacgtgcttctttaatttctgcaggccgtaaaaaagaacctacgatgtcataagttaatgtgtcttttatcatatgaaaacctccgattttttgattatttgtctttgcttagttgatgattttattatgccagatgtaatagtttttgcataatacttaaaattgtgggtttggtataggtttaaactatatcatatgaaaaagaagatcaaaattgctgtttgtggatatttaaaaatttttattatcttaaaaagtgtataatataaatatgacatgtgttacattagagttgaaatcacaggagaaaaaggaaatcgaatatgaacagcagaaaaaaagtcttatggaagatattcatttcaacattatatttaagggcatttacattcggcggtggctacgtgatcgtaagttttatgaagaagaaattcgtagatgagcttcactggatcgaagagaaagaaatgctggatttggttgcgatcgtattcactgggtcagaccctattaagggtacagtgcggaaaagggtatgtggagatgtgaaagtcttgcatacttttttcttgtgcgttgaacatatatgatttattctaaataatagttaagcaaatttcagtttttgaaactgagacatcgggactttacagggaggttattacatgaagaaattagtatcagtatcaataaaaacgattatcttttttgttggttgggcaatatgtgtatcagttatacctataccgaatacagctagtgcggtaatctggagattttgggcagaattaataccgcttgtatctattattgcgctaacgcttatcttttggctgatagataaaagaaagacacgcttacatttgactggaaaactggttaataatatcatattaggatgtgtaacaggagcagtttggttaggcgtatctgttggaatattagctataataggagttgtacatatagatggtagaaatcaaatctctatgctatggttgtggatgatatcggcttttctcaatactgttatgcaagaaatgttggttcgtggttatttatatcagatgttaaaaagcaactgcaatataggtattgctgttattgtatctactggcttatttacatttgcacatggtggtgcttttgaggcgggaattcttccagtgcttaatgtcataacaatgagtctttttgtgacggcagttttggaatatacagattccttaattgctccgattgtaattcattttttatggaaaggtgttggtgcaattattttgggaggagtatctttggcagaagattatccacatttatttaacatggtaattagtggtaattcaattctgtctggtggtagttgtaaaattgaaggtagcataattgtacttcttatgaatttgatttttatggttggatttataatggcaaataagaaaaagggtaaaatatataaatcctaatttactttggagaagagaatgaataaaggaagttgtaagcaggaaacaagtctgacacaactttgtgataaaattattaccatatgtaaaagataagaaaacgataaggagaaagaaaataaatgatctctgtattggttatagaagatgatacccagattagccgtctgatcgagtcaacgctgaccgcagaaggctatcactgtgaatgtgcacttgatgggcagatcggagctgactgtattgaggaaaaagtatatgatttgattcttctggatttgatgctgccccaaattagcggctacgaactgctggaatatatcgtaactgtcggaacaccggtcatcattatttctgctatgggacaggtcaaagaccgcatccggggacttcgtatgggtgcggatgattatttaagtaagccgtttcagattggagagcttttggcacgtgtagagacggtacttcgccgtacaaagcggatacaggataagattacgatagatgatgtgacgcttgatccggtatcccgccaggtatttaaagatgggcatcagatcaatctgactgtgaaagaatttgatcttctgatggagttggttgggaacaaaaatgtggctttgagccgtgccagactgtacgaagcagtctgggaggaagaatacagtggtgagaccagaacgctggattctcatatccagcgtctgcgtaaaaaactggattggaatgaccggattgtgacagtatttcgcatcggataccggctggaggttcatcagtgaaatttttctataagatatttttaagcatgctgctggtgctgacggtatctttggcaaccatagagtacctgacggtatcgtacagtctggagcatgcattgcagcgggaagaaaataccgcactctcccaacatcagatggccaaatattcgatccagacagtgctacttggcattacggacgattacacaacgtccaatatggaaaatatcgcaaaatcggcagaaacgcctcttggtgctcaaagtggtttgttttttgccagtcagaacagccagtcagggagagatgagacagtgtattataattcctgtaagatcaatccttcggacagaataccggcgacgggaatactggaatacgagatacgggaaacagaaaaagacagatatctgcaggttagaagcagttttacactcgataccaacagctttgtgctggttacagagaaaaatgtaaaagaactgtttcaggatgcggatacactgcgcaggcgctgtgaattcttttactggtgcattcttgctaccggttcatttttggtgcttgtgattacctttaccttaacaaagccattgcacagactgcaaggcacaacccggagatttgctaaaggagagtatgatgtacgagcagagatcagtagccgggacgaaataggggatctgtcaaaaacatttaattatatggcaaagacgatagaaagcaagatggaagagctgaaggatgcggtcagaagacaggaggagtttacagcaaactttgcccatgagctgaaaacaccgatgacgtcaatcataggatatgccgatacgttgtatcagaagactctgtcgccggaggaagtacatcaactggccggaatcattatgaatgaaagcatgcgtctggaggcactttcctttaagctgatggagcttgttacgctgtcgcaatctaattttcagctagaagaagccaggattgatgaggttattgcagatgctgtggaaacgatccaaccgacagcagaaaaaagaaatgttcgggtgcagcttcagacagaaccagcctgggtacgtctggaatatgatctctttaagacacttttattgaatctgatggataatgccttaaaatcgggtacggaccggataaatatacagggaagctgtgaaaaagaacagtatatgatttccattcgtgattacggacggggaatcccgaaagaagatctgcaaaagatcactgaggctttttatatggtggacaaatcacgctcgcggaaggagcacggcgcaggtcttggccttgcactggcagtaaaaatcgcaaagctgcatcatacagagcttgtttatgagagtgtggccggacagggaacctgtgtatcgtttatgttagcaaaggaggcggatgatgaagaagaggaagcttaaagtactgtatattcttcttaccgtgacactggcgtttttgattgcactgacgggaatgttcgtccccaagcttcttctgaatacaaaggcaaagaaactggcaactgccacagggagaatggataatggagatgtatcaccatatacctatacgatggatacaaagacccggattgccagagtagaaaagctggtagagcagatatttataagtggtgcagatatgtatataaacgtacgtgatcctcttgacacggagctttcctgcgaacaggctcagaggacgataaagaaatttctgatagcatatgcggatatgctggaagaatacggacttttgagtacggtggagcgtaatgatacggacgcgccggtgttcggttcaggaaatgatgggaatctgcagtatcaggacaggctgacagaaagtggggacgcacagttggagagagactgtacctatattcagatggagccaccggattttatggtgtcgccggaggatcagcaattgtctgtatgggtggactcgggttatatctatgatcagtttgtggagatcaccattgatgctgtgactgggctgccggttaccgtacagtttggtatagcaggtatagagcctgatgagacctggtgtgaagccacagcagcagtgcttgaaaaagtatatggaatagatttgaagtttggcgcacccgagatgttgtatgagccttatgccggagacatgatgcgtcaggcaggaaagatggactttgaatatgcgtatggtttttcctgtgtaacgcaggacaatgcgctgcatatggagtatcagtactatagcgaagataccgggtatgcgaaaagtaaaacctcccgagatgtatatggtgaaatatatatatgcttttacggggaatagagctgtacattttatggagtctggtacggctccactgcgatttgacaactcagacacaactttgcgacaggatggagataacctcctgctatactgtggatatacggtatagcaggaggcattttttatgaaagaaccaatgacagatgtaaggagaaaacaactttacaggataaaaaaacgaaaaagaagaaaacaatgtataagagtcgctcttcgcatggcagtactgtgttttctggttctgtttgctgtgcagaaaacagcagatctgcttcgggtggatgacagtgacaggatggaggatgcagaacagtcatacagtggacagggaggaaagacacggacaaatacggaaaaaacatggggagtattcgaaaaagcagatgtgctgacacaggaagacaagctgcatagtatagaagaaagtgatgagtatcctgaccagcttaaggaattggcagaaaaaaatagtgagacaattgattttgtctatgattatccggaaatgaaggataaaaagcaaacgattgatctgtcacaagaagccaaaaccgatacagtaccgcttctattgcagtgggatgaacgctgggggtatatgccgtacagtggaggtctcctcggctacaccggctgcggaccgacgaatctggcaatggtcgttttgtatctgaccggagataaaacggttacaccggcatctgtagcagaatatgcagagagtgccggatacagtgtgccgggatcaggtagcagctggacactgattagtgaaggttgtgaacattatgggattcatgctgaggaagtgccgatggatgaggacagaataaaggcaaaactggatgagggatgtctgatcatcatcaatgtaggacccggagattttacagattccggccattttataacgataatcggatatgacagggacggttttatcatcaatgacagcaacagtcgcacaaacagtaaaaaaagatggtcatatgagcagttgagcagacagatgcggaatctatgggccatgtataactgaagggaaaagccagatgttgaacagcttttgaacagtgatactaccatatttttcatatagcagcgattgaaacacaaggattttagaatttagatatttttctaaatagttgttgacaattctgtttcggcagaatatattatatttagaaatatttctaaatacttttgaaagaagtgatgctatggcttttgcagatacttttaaggccttgtccgatcctgcacgccgagaaatcttacagttattaaagaatggccgaatgtccgccggagaaattggtagtcattttcatatgaccggtgctactgtttcctatcatctaaagattttgaaaaaggctgatctgatatgggaaacaaaagaaaagaattttatttactatgatttgaatacttccgttgtagaagaattacttctatggttaaaagacttgaaaggagacgaatctcatgatgaaaaaatataaatggtctttgttacttggcagccttctttctttaagcccgatcttgatcggattgcttttgtggaatcagcttccgacaaagattcctacccatttttccactggaaatactccagatggctggagcagcaaggcaattaccgttttcggacttccgctttttatgtttgcaatgatgtggttttgctttcttttcacccatgttgatccaaaacgccagaacatcagtccgaagctgatccgggcacttgtgtggttcatggctgcactttccccgattgttgtgtgctctagctatgctattgctcttggaataaatgtgaatattactctgctcacttatctgatcattggactcatgcttttggtaattggcaattatctggcaaaaacaaaacagaactatagtgctggcattcggattccatggacactgtccagtgaagaaaactggaatcgcacacaccgtttcagctccagactgtttatcttttgtggcctggctatgatcgccaatggatttctggactctaagatactgttatttttcatcatggcagtgttgatcgttatcccatatgcatattcttttttcttatttaaaaaaggaatatgatgtacacttttggaacatgcctttgtagctgcaataagggcatattatagtatcaatttaacgaaagatattgtaccgggaaatatgtatcaggtgattaatgatcaggaatatagcctgaatgaacaatttcataagtactggacgaaatctgcactttttcatccgataggacgaaggcaacgtataaattcagatgttctgatacagggcgtggtatgagtaaagattttatttcccatgtatttgaaccatttgcacaagaggattcctgtgcaagaaccagctatatgggtacgggactcggaatggcgattgctaaacggcttacagaaatgaaggatggcaatattgctgtagaaagtgagttagatgtcggaacaacatttacagttacaattccatttgaacttgattctaattataaagaagcatatgctctggaaaatgttgatttctcaaaaagcctttccggtctgaaagtgcttttggtagaagataatgaactgaatatggaaatagcaaaatttattcttgaaaatgcagagttagaatcaataacaatgagaaaggaagtacgagattagacatctataacaaagataccaatatagtgtacgattacaaatttgtaaagaatcccggtaagggtctttcaaaaaggcagattaaaaaaataaagaaagaaggcccattaggattaggtaacgaggatattatagagattaatccaaattaaataatttatttaagctattgcaaccaatatgttgcaatagcttagaaaagaggtaaatatgggacgaccaaaaataaataaaactaaaataacaaatgattggcagaagtattgtcctgaattaagaaaattgcgtatgcttgatatagataatagagtaggaccgttagtaatcggcttctatttacaagtaataggagacgggacgatttatatgccgttatataaagtggaaaatctatatagccattatagtgtattaccttctagtttggaaatagaaggtcgaacaatggatatgcagacacacgaagcttatagcgagcaagttgcgcagcaattgattgaaaaagcttatattccgttacaaggtgaagtgacatttgagaatataaaaaatgggtatgaaagatattttaaaaatccaaataagggaacaattgtggaatatgaggactatgtgtatatcagtagttggacaagaaataagttattttttgagaccgcattaaatacggtttataatgaactaaaagcatggcctgaagaaagatattttgtacaggctggaggatttcaaaattggatattagaactggaaaaaaaggcgagcaatcatgaaatattagaagacaattatagaaaaaaaattgcaaaatataaaattgagaaattgccagaaagaccattttatttttaaatgaaatacagagaaaatgacaatgaatttaaaagaaatagaaaaacaattatataccgataaatatttagatgaaaaaagtattatatttatgcatcaattattaacgaaataggcggtttcatcggaagtgtcaaaggattagtattactgagtatatatgaatattcactgaagtggtcagaccctattaagaaaaaaagtacataatagctatatgtaaatcaggagagaaggtgaaaataattaatattgcttaacaataaatgtttaggcgtttatatttgaaacaataaaagaaaggagatggaatatgggaaaaaaatgcatttacattgtattgtttatttctacaggaatttacgcaattgcagattattattgtatttacaattttacatttacccttctatttacgatatttttaatttttaatttagtaaatagtgtaatatgttttgcaaaaaatggctgtgaattttctataattgcatctattatttatgtttttatgatagtgcataatcttttcgttctcgcttttaactattccattagttcaggaggatttcatagcatttgaggagaccagctatgaagaaaattatatctggaatattaacgctgagtttggcaatcatattatttgcaaatatggaacaaagatgtcaaagccgaaatcgaacgtcgtgtaaacgactcaaatcaataatcaatcatatgtgaattgtcaaggtactccggccgcaaaaatgcagccggggatttttatatccatgtctaaaatttaagtgcttacaatatttacgatacagggcagcttttttttcatatttttcgggatattttttatctatatgcgtctaatctatgtaagaaaaataaatcggccgatataaaggtggtgttaaagtgacaaaagagcaattgggagtactgattctcgactgcgagaggcagttatattctacagccaagacaatcttatacagtgatcaggactgtgctgatgccattcaagatacgattgtaaaggcattttccaagattcaaacattgaaaaatgacaaatatgcaaaaacatggctgattcggatcctgatcaatgaatgttataccattttgcgaaaatccagtaaactgacttcgttggatgtgatggatgagcagacgaaggcagaaaaaataatgatgacaaaggaaaaggctgattacagtgaattgtaccaggcaatcaatgcattaaaagaagaattgcgacttccggtaattttgtattatattgaggattttaatatccgggaaatcgcacagattctggatattacagaaggtgcagtacagaaacgacttgccagggcaagaggaaaacttagatgcaatctgcgagaaagtgaggcggcgatatgaggtttgaagatatgaaaaacaatattccggagactccggagtttatccatgtaatgatacaaaatgaagtagacagacagcttcagggaactacaattatacagattccgaagaaaaggaagaaatggaacggtgcaagagtggcagcggcagcaatggtctgcgtgctggcaacttccacagcagcttatgcgggtgtgaaaatgtaccgcatgtatgtggaaaaacagggcgattacagtgtgaagacggggataacatcagaaaataaattagcagatcttccggcgcagattcacgatattgatttcaagaccggatatattccggatggcatgaaatgggtagacgagtcacatctggaatatccgcaaagcaaacgtatgggaggatttagttttgcgtccgtacttttggacaatgatgatctgaatcaggcactggaaaataaaaatgttgtcgagtccgaggagagaacatttggcaaatacgaaggtgtatatctgaaatataataatttaaagactgaaaaaggtacatttgaccaaagaatctatctcttttgcccggataaataccgtgtgatcacaatctatatcggagatgatgtatcgaaagatgatgctgtgaaagtagcagaaaatcttgagattacagaaaatgacaagatgatggaaacagcgaagatgtatacctggagcgatgaggtcaacccgaacgttgagaccgacgatgaaatggtaacgtctgtgtctgaggataaattaaaggtgtacaagattggcgaagattttacattatctgcatcaggagaagataaagacggaaacaatatcgtaaatgataaaatttctgcccacgtagattcggttcagacagcggataatctgaagttgcttaacggtgcagacttaccggaagaatggaaaaatgtaatcgattccaacggaaaacttgtaaagaataaagtttcttatatcaaatccggcgatggtgtgaattctgtagatcaggttattaaaacagaaaatgtaaatcagaaacttgtttatgcaacagtcacgtatacaaataattcagataaggaaatcaagcacatgttgtatatcggaaatctggcattgattcatcatgaaaacggggaataccatatttataatgcaatggaacagtccggtaacggatatgaccgtgtgagttgggacggcgtggcgcatactgcagaaatgacctacagtagtgtgcgagaagattatgggaatggcggtaattatatttcgtctctgaaaccgggcgagagcattcaagtcaacatggcatggatcgtcaatgaagataatctggcggatatgtacctgaatctggacggcgaaggcagtgcctatgattttaacgaaggtatgctggaagcaggagttgtggatatcagaaagtagaaaacagccgacactttgcgaagaatgcaaagtgtcggctgttttctactttctgaagattcataacttacagactgaaagggcagtccctattaagagagatgattgaaagcacgaaaaatatagttgtatgatccaggttgtagaaaatataaattatagctataatatgagtaagaaaatttgtaagtgaagataagaagaacggttgtaggtctatgctaacaacggaatctgtaaccataaaagatccagtaggaatgtcgaaatatttactgacaatgaatccggaaatggaacttacgagaaatataaattcaaggatggaacgatactatgttaaatatttttttgggagagatgaaggatgcaatttatcatccgccgacatactttgataatgtgtatgaagacgaatggattacagatccattgtcgatagaaatgattcgtgatatagataagtcagatgtgataggggtacatttgatagaaagtcctgttctgggtccgatatcgccgaaagacttgtctggaggagttaagacattgatgttaatggcttttgcagatcaagagaaagtattcaatgcatctgcatgcggggataattgtgcaaagtggattttgaaaattggacaagaaaaagacctgacgattaatttaaatcatatcatgaattttggagaggattcatttgaggcaaaaatattaaatacaggggaagtagttcatgatatgctggattttataaaaattgccggacaatatgtataggggataggcatgaagggaaaacataaagttgttataaaaaataacagattgcattatgaatttgaaataaaaaggaatattacaattataaaaggtgacagtgcaacgggaaaaacaacgttgattaatatgatccgtcagtttaccaaccttgggaattccagtgggatagagttagtgtgtgatgtgccatgcagagtattggaaggaattgactggcagatcattttacacaatatttcaggaaatattatatttatagatgaagaaaatgcattcataaaaacagagcaatttgccaaggctgttcgagaatcagataattattttgttttgattacgagagaaaatttgtataatctgccatatagcgtagaagaaatctacggactgcattcatctggaaaatatcagaatacaaaaagaatataaaaatgtatttaccggaatcatttgaatggatgatattgaatgtaggtgtggttcaagaaaaagaaattatggagattctaaaagaaccagaaaaatatatagaaagtcaaaaatattttagctgggaaagatttttcaccaattattgatagagaagactgatggaacatatatgaagtaccagaaaagtaagctaaatccagtttatctgcatgaaaagaataaaagaatgattctaagcagtgctagaggaatcctatgaaaaagttgtacaaatgaagcagagatggttatgagttataaacaattaatgaaaaaatatatatggctattattttgtagtattataacgatgctggtatctggatatgtgtatataaatcattattttagttttattatgctcattggtgtcacctgtagtataggttcaactattgaattaatatcattgatcattacaacacataaaggtaataaggaagagtagcaaaaaagatcagttatgacatgtgttacattagagttgaaatcacaggagaaaaaggaaatcgaatatgaacagcagaaaaaaagtcttatggaagatattcatttcaacattatatttaagcgcatttacattcggcggtggctacgtgatcgtgagtttgatgaagaagaaattcgtagatgagcttcactggatcgaagagaaagaaatgctggatctggttgcgatcgcacagtcttcacccggggcgattgcgataaacggatcgattgtcgtaggatataagcttgcgggaattaccggtgtactggtatcgatcattggaacaattattccgccatttgttattatatcgttactttcggtttgttataatacatttcgtagtaatgaactggtaagtcagatgctggaaggcatgcaggcgggagtcggagcggtgattgcatcggtgacgtatgagatgggagcaggcatagtgaaggaaaaggacggaatctcactgctgatcatggcaggggcatttgtagcatcctgtgtatttgaggtaaatgttgtgtatattgtgatcatatgtggattgctgggggttttacgcacatgtatgaacaggaaaggggcaggcaaatgatatatctgcagcttttttttagttttttacaggttgggatgttcagctttggcggcggttatgcggcgatgcctttgatacagggacaggttgtgacgggacatcattggcttagtatgtcggaatttacggatcttattacaatctcccagatgacaccgggaccgatcgcggtaaattcggcaacctttgtcggaatcaagattgcgggaataccgggtgcgctggcggcaacatttggatgcattctgccctcatgtattatcgtaactgtcattgcaaaactctatttaaaatatcgcagtatggaggtactgcaaggcgtgctggggtctttaagacctgccgttgtggcgatgatcgcatcagcagggatcgcaatcatgatcacggcattctggggaagcagggatcagatcgcacttgcggggacgaagtggagtctggtagtgatttttgcagtctgcatgatattacttcggaaagtgaaaatgaatccaatatgggtgatggttatggccggagtgatgaaagtgggaatgtcactcatttgaaatcgggctaccgcaatcccactggctttagacggtggggtaaggtagccggaagcggaggtttgtgctacacttgcgttatgggaacgtggaaatcaaaaaacagacacaaatatttgttacagtatcatattatttccgtatgcaagagtatagaaagaaattgctgatgtcaaaacaaatatcagatgatataaagcagttttcttatgagatatgtcaaaagcataaagtcattatcagatatatggagacagataaagatcatattcattacatgatagaaacagaaccaacaatgtctatcagtaaaatagtaaatctgatgaagaattatacaacatatcatatttggaaaagatatccggattatctacgaaaacatttttggaaagaacatactttttggacggacggatattttgtctgcagtgtaggaaatgtttcagaagagatgttgagaaaatatatagaaaatcaagggtaggaaggtggcgacagtgggtgttaaaagcatataaatacaggatatatcctaatagcgaacaaagaattcagattgcaaaaacatttggctgttgccgttttgtttacaatcagacattggcatatcggaaagaaatatacgagaaagagaaaaagtcagttagtaaaacggattgtaataattattgtaacagagaattaaagaaagactatgaatggttaaaagaaatagataaatttgctctgaccaacgcaatctataacatggacgcttcatatcaaaaattctttaaggagcatgcaggatatccgaaattcaagagcaaacacgataaccataaatcatacacaacaaacttcacaaatggaaatattgcggtagattttgagacagggaagataaaattgccaaaattaaaaacggtaaaagcaaggttacacagggaatatagtgggcagattaagtcagcgaccatttcgcaggtttccagtggaaaatactatgtgtccatacttgtaaaaacggagcataaggaactggcacatacaaatcataacataggaatcgatttaggaattaaagatttatgtattacttccgatgggaaggtatatgagagtctaaaaatcataaaaaaatacgagaaacagcttgtaaagctgcaaaggcaactgtcacataaaggaaagagaagtaagaactattataaaacaaagaaaaagatagcattatgccatgagaaaataaggaatataagaaaagattatctacataaagtttcacatgagattatcagcgaaaaccaagtgatagtttcagagaatttacagataaaaaacatggtaaaaaatcatcatctggcaaaagccataagtgatgtatcatggtatgagctgacaagacagttagagtataaggcaaaatggaatggcaggaaatacatcaaaatagatacattttatgctagtagtcaattatgttctgtttgtgggtatcagaatccagatacaaaagatttgtcagtgaggacatggatatgtccgaaatgcggagcagaacatgacagggatatcaatgctgcgaaaaatatactgacagaaggattaagacaaatagcataaagaaatatataggacagggactgcccaaattaacgcctgtggagatagtaggttacgaggtcgatgaagcaggaagcccattggcttaagacaatgggtagttcactaaaggggaaattacatagggaaaaaacaaaaaatgtggaaaaagcaggagagggacaaaaaaatggggaaaaaaacaattgagaaaaatgcgatcacggaaggagttatctggaaacaattgttgatcttcttcttcccgatcatgcttgggacgttgatccagcagttatatacaactgtggatacaatcattgtaggacgcttcgtgggaaaagcggcacttgccagtgtcggaggaccggcagccgtcttatcaacaattgttgttacattctttaatgggctggcgaacggggcagcagttattatcgcacaatattatggtgcaaaggacaggaagagcctgcatgtgggggtacatacggcatatctgttctctgtcgtgatcagtctgatcgtatcactgaccggtacagtattgacaccatggctgcttaaaatcatgaatacaccacaggatatgatggcagattccataacttatctcagaatttactttatgggaattttgtttacgctggtctacaatatgggatcggcaatcatgagggcggtcggagattccagaagaccacttctctatctgttgatctgctgtgtgatgaatatcatactggacattgtcatggtggtaggaatgaagatggggattgcgggggcagcactcgcaacggttatttcacaatgtgtcagtgcagttctggttacctggtcgctgactagggcatatgatgctatgaaattaaagttccgggaactccggatggatgccggagtgttgagaaaagaattgaaaatcggtgttcctggggcacttcaggcatgtgcctacggtgtgacgaatgtagtgatccaggcatccgtcaacagttttggtacagataccgctgcaggatgggcagcttacggaaagcttgatatgatcttctggacagtatcgagcgcgcttggtgcggccgtgaccacattcgccggacagaactacggggcgggaaagatggacagggtatataaaagtatccgggtgaatgtagtgatctcttatatatttacaggagctattattatagtcctgtttgcattctgcgaaccgttataccatatgttcacgacagatccaaaggtcatcgggataggagtatatatgttacgtttcctgattccgagttatctgttgagtgtgctgcttgagaatctgtccggaggactgcgtggtctgggagatgtcctctggccgactatatttacattcggaggtctgttctttgtaaggcttccgtggatcataatccttacgaagatgcatcataaggtggagatcctgctgatcagttatccgatggcatggggggcaacattactttgtctgatcccgtactatttctggcggaagaaaagaagaatgagtacatatggatcccatcttcaaaaatcatagattatatgttaaaatatagacagtatgtttggagaaaagagtagcaggaaaggacaggaagaatgatgtgtgcgatgacggataagaaggactgtatgacaatggagcaggcagaacagaagatggagtgcctgagagaagtgttctcaattgtacgtctggttgatggtgagatgctggagaagagagcagaacacagtccggatgcagatgcaatggagatgtgtcagtgctattcattctggaataaggcaaagccgtgtgagaattgcatatctatgaaatcgctgagagaaaaaaaacaggcagcgaagctggaatttctggattcggatatttttcaggtgttttcaagatatgtggagattgatggaaaaccgtacgtaatggagatgttgaagaagctggatgaagacacattgattgatgcggttggatatgggaagatggtccaaaagctttctgtttataatgacaagctttacagagatgcgctgacaggggcttataatcggagatactatgaagatgagattaagcatgtaaagggaaaagcaggggttgcgattcttgatgtagatgattttaagttatataatgatatgcatggtcatcacgcaggagatatggcactgattacagtggtagaagtaatacggcaatatatcagaaagacagataaactgatcagatacggaggggatgaatttctgcttttactgccggagatcgacagtgagaactttgcgcggaagctgaataagattaagaaaaaaattgctgaaacgagtgtcccaggatatgagcggattaagttatcagtcagcatcggaggtgtgtcagcaacagaagagacagtggaagaggctgtccagagagcggataaacggatgtaccttgctaaaatgtataaaaatactgcaatggtagaggaaatggatcagaaaatagcggaggaggatcatgatgagcatacggatattctaaagccacggattcttattgtagatgattctaagatcaaccgagaacttctgacagaaattctgcaggataagtaccagatcatagaagcggaaaacgggaacgaatgtgtggagaagctggagaaatatggaaatgatatagcattgatacttctagatattgtgatgccgaagatggatggatttgcagtactggaatatatgaatcaggaacagtggatagatgacattccggtaattgtaatatcaggagaggattcggaagaatctatctggagagcttacgaagccggtgccgtggattatattaggcgtccgtttgatatgcggatcgtatatcaacgggtatttaacatgatcaaattatatgcaaaacagcgcagactggtaaaaatcctgacagcgcagatagaagagagagaaaacctgtcacagatttccgacaagtcataatcattgatgagacttggagaaaatctgcggcaggttttctttgttaataatttccgagtttattcagatatttgtcaatcgtattaagtcttttttcaattcctttggccttatggctgatgatttccagcaaagactctgttacgaactgcggaccgatcatagagttgaagaatgtattactgtctaccgggactgtgagaagaatgtcggcatattgtgcaagcagggaacttggcttatcggtgatcacgattattgaagctccggcatcgcgtgccatctcggcggtcactttgtcctgagaagaatatcttggaaaactaaataataccagacagtcggtctgcgagatattgcacatatgatcaatcgggctcatggaagttgtggttgtcatggttacatgcggaaccatctgttttaaatacaggaggaagaaatctgcaagacagatatttcctctcgttgcagcaatgtatttgtgcttactggaaacgataagatccgcagccttttcaaatgtctcaatagagttttggataaatatctcttcaagattatgagcagcattcttaaaatgccggttgatgtaatcagaagagttgtctaatttcgcctgctttgcaatccgctgggatgggatcgtgatactgctggaaatgctgagtactttgtcctgatattctttccgcagtgccttctgaaaatccataaagccgtcaaatccgatcgtacggctgaaacggattacggaagactcactcaccccgagctttaaagcaatctccgtagatgtcataaaacaggcttccgaagcattatccagaacatattccgcaatgatcctctgcgtcttggtaagatgtgcagaatggagtaattccttcatatctttcataatatagttcctccgaaagtgatatagataattagattaaaacatgaatctgggaaagttgcaagacggagagcatgaaaaaagaaaaaaacgtgtggatatggggaaaagaagatagaacctatagatagtgatgattttttctcgttatttatatatcacacaaatgaagcatactccaatctttttgaatgaaaatcgtaaaaaaataagaaaactatgtgcatattgcacaaaaatatgtgtgaaaataataacacatatggataaagtgcaaaaataattgtgtacaaaaaaataaaggtatgttattatcaaaccaacgaacgacgaaagagaggaaaagaaatgttacaaacaattgaaaacgtgaatgcggccgttaacaatttcgtctggggggttccggcaatggtctgtatcatcggtgtagggcttgtactttcagcacgtacaggatttatacagttccgaaaatttggatatgccattaagaattctatcggacgtatcttcacaaagtcagaagcgaaagaaggtagtatcactccattccaggcagtgtgtacggcgcttgcggcaacggtaggaacgggaaatattgccggagttgccggtgcgattgcaatcggaggagcaggagcagtgttctggatgtgggtgtccgcattgcttggaatgtgtacgaagttctcagaagttacacttgcggttcattacagagagaagaatgcagagggagattatgttgggggcccgatgtattatatcaagaacggtcttggcaagaaatggtactggatggcttcggtctatgcgatccttggaagtttgacagtactcggaacaggaaatgcaacacaggtaaataccattacgacatccatcgattcagcacttataagctacaatgtgatcgatgacgcacagataagtatggtgaatctggtgatcggaattgtgatcgcagcactggtagcggttgttttacttggcggagtaaaacgtatcggtaccgtaacagagaagctggttccattcatggcagtattctatatcatccttgcaatcggagtagttgcactgaatgcagacaaagttccacatgtatttgagatgatctttgtaggagcatttaacccgtcagcatttaccggcggtgtggttggaagcatgtttatgactatgagacgtggtgtttccagaggtatcttctcaaatgaagccggaatcggtaccggatcgatcgcacatgcatgtgcagatacagatgagcctgtaaaacagggtatgtttggaatctttgaagtatttgcagatacaatcgtgatctgtacactgacagcattggttatcctttgtggcggcgaaggaatccagtacggcgtggcagcaggtgcggagcttacaatctcaggattcgtaactacatatggcagctgggtgacgatctttactgcaattgcaatgtgctgtttcgcattctcaacgattcttggatgggggctttacggagcaagatgtatcgagtttgtatttacaacaaaggttgtgaaaccatttatgatcgtgtatgcgctggtcgcaatccttggtgcaacagtggatcttggtatcatctggggaattgcagatacctgtaatggtctgatgtctatccctaacttgatcgcattattcctgatgtcaggaacagtggcaaaactggtaaaagattactttgcaaaagaaaagaaaaagaattagaaagacaaaaaaataacttactagtgaaaaaaataacttttattgcattaacaacttgagtgtgttaatatgagttcagacagaaatgaagaatattcttcatcgaaataacgaaaagaaaaataatcttcacttcaaaaacaaacggattaaaatttttaggaggtttttcaaaatgaaagtaggatgtgtaaaagagattaaaaacaacgagttccgtgtaggtatgacacctgacaatgttaagagttatgtgaacgcaggacacgatgtttatatcgaaaaaggtgccggagaaggatcaggattcttagatgccgaatatgtggcagctggggctaagatgattgatacagcaaaagaagtatgggatactgtagagatgatgatcaaagtaaaagagccgcttccggaagaatatccattattccatgaaggactgatcctttatacatatcttcaccttgcagctgacaagccgcagacagatgctcttctcggagcaaaggtaaaaggtgttgcttatgagacactgatcgaaagaaacggaagtattccgctgcttgctccaatgagccagatcgcaggacgtctgagtattcaggaaggtgctaaatatctcgagaagagatttggaggagaaggagttctcttagcaggagttcctggaacaccaaaggctaacatcgtaatccttggaggcggatctgtaggaacaaacgcttgtaagatcgctgtaggaatgggcgctaatgtaacaatcatggacatcaaccttcagagacttgcttatctggacgatatcttcggagcacgtatccagacacttgtttctaatgatgcaaatatcgaaaaagctgtaaaagaagcagacctcgtaatcggatgtgttctgattccaggaaaatcagctcctaagatcttcaagaaaaaatatctcaaagagatgaaaccaggtgctgtatttgtagacgtagctgttgatcagggcggatgtggtgagacaacaaaagttacataccacgatgatccgatcttcattgaagatggtgttgttcactactgcgtaggaaatatgcctggagcagttccaagaacatctacaattgcactgacaaatgctacactgtcttatggactgcagattgcaggaaaaggacttgagcaggcatgcaaagataacgaagttatctattcagctgtaaatacatacgatggaaaattaacatgcaagaacgtagcagacagctttgactgctatgaatacacagatatcagaactgtatgttaattgaatcgctattataataagaagcaactaaaactaaatgattgattcctatgagtgggaaaatgccggtatcttggggtgccggcatttttcttttgagttttctgtattgggctttaagcatgcagttcccgagatgatagcattgtggaaaatgcacacagatctaatgatcggagttatcgtatgcccgatcacttccggagataccgcattccgtagtgcacgtctggtactggcagactggttcaaagttgatcagaataagatgcagaaacgtctgatgttatgtgttccgcttctggcagtcggagcatttgtcggacatctggattatgcaatcgtatggagatacttcagctggacaaaccagacacttgctatgatcgttctgtggacagcaagtatgtatctgttccgcgagaagaagaattactggatcacagcggtaccggcaacattcatgagtgcagtttccatgacctatttcttctgtgcagaagagtgtctgggactttctacgaaggttgcttatccggtaggaattatcctggcagcagtattccttggaatctttatccatgcgacaaagaaaccaatgaaagcatagttgtaagacagtgtaatttgaatacataaaaaggcagaatgaattgacagaaatgagatgatgaaaagatgaaaccacaaagactgggtaatgtatcgattccggatgaagaattggtaaaagacaaaaaagaatgtaagaagatcggaccttgtggcattggaaaaaaggcagtgtatcttagcagcttctatattgacagaaggtattacataccgatcagttctgtaaaaaggatcttcaaaagaatcgccatgagtaagggcggatttacaggaaaaggagtattcggtacattatcctatcttgtggtcgtatatgaggacggaaaagaaaagcaatgtaatttcaaacatgaagaagatgtggacagatttcttgcgtacatagaagaagaatatccggatattccggtacacagtcttgaggctgagagaaagctggcagagaaggaaagatggctggcagaaaagcaaagagaaagaaatgtatcggaagaaacaaaaagatgtctcgtgaagctggaacaggcagaacagtatctgaaaaagcaatcggatatctatatggacttgagtcagtcggcgaagaaaaagcgtacttatgacagaagtaatccggcgtataaatgggtagctcttgcaatcgtactgatgggcggtgcggcattcgtctatggtatctatgcattgacgacccatgcaggatttggaatgtatttccttttgtttggtctggctgcaatctttttatttgccggagcgaatgtacttccgacttcgaagaataataagaattatattgagaagcggctgacggaatcgatcagtcagatggaagagtatatcagagtgtatccggattttccggtaccggctcactatgcacatccgattgtgctaaagagaatgcaggaaattatgaaagaagggcgtgcgagaaatattccggaagcattgcaggttttgaaaaaagatctgaaagcgttgaattccagcgtagtcgtagagaaagaagagtatgatgaagtggtagcgatcaaaccgatgtttctggtgatggattataaataaaataatggtaaacggattttgaaatatggctggcatatatcatgaaagaatatatgtcagccatattttatacgtcatgtgtttggaagaagctgccagtggcaggtctctagattctaagcttaaatacatatgctaaaaccaggaatagtattgcgatacattttacaccaatggacactccgacataccccggtaacaaatagcccctttgctttttccctgatattaaagaaatgatatcaattatgaaaaagacgatcagaacaattgcggcaccgaagatcagcagcatggcatcaccatgattatgtgtcagtgcagttacgactccgacatttgtaagtgacatccaactgtagattatgtatatcatgcatattaagttaaaaataatatcaaagacaacttttttgttttctgttccgttcttcattttaatgtcccctttctttaagagaatttggtaatagccggcattcttatcaattttttgtttcttctcttttgttgtctataatataaaccatcaagtaacttgaaggtcaatagttttagaaaaaataatttgtaactgcttctgtattgtggaaaaatcagaatattggtataataagaacatacattcgaagtagaaaaactttgtgaataaatttgcgagtaaaggaagaatgagaacaggcatggcaggcaaagaacagaaaagctatattgcaatcgacttgaaatcgttttacgcatcggtagaatgtaaagaaagaaaactggatccgatgacgaccaatctggtagtagcggacaaaagccgtacggaaaagactatctgtctggcagtgtctccttccttgaaatcctacgggataccgggccgtgccagacttttcgaggttgtgcagaaggtgaaagaagtgaataaaagacggatctgcatggcacccggaaagaagtttgcaggagcttccgtagataatgaagaaataaaactacatccggaattggaactggattatattacggcggttccgagaatggcattatatatgaaatgcagtacggagatctacaacatttatctgaaatacgttgcaccggaggatatccatgtctattccatcgacgaggtattcatggatgtgactgattatctgaatacttaccgtatgacggcaagggagctggctgggaagatcattcgggaaatccagcaggagacgtcgattgcggcaactgccggaatcggaacaaatctgtacctgtgtaaagttgccatggatattgtggcgaagcatatcgagccggatcagaatggggtgagaatcgcagaacttacagaaatttcttataggaagctcttgtgggcacatcagccgatcacggatttctggcgtgtgggcccggggtatgcgaagaagcttgcggaagtcggattattcaccatgggagatgtggcaagatgctcgcttgggaaaacaggagattattataatgaagatctgctgtaccggttgtttggcatcaatgcagaacttctgatcgatcatgcatggggatgggagccttgcacgatcacagatgtgaaggcgtataagcctgagaataacagtatgggtgcgggacaggtactgcactgtccatatgatttcgaacagacaaagatcgtggtaaaggaaatgattgaccaactggcgctggatctggtagataaatgtcttgtgacagatcagatcgttctgacgatcggatatgacatcaagaatctggaacaaggaatgaagaaaaatgtaggagagatcacgacggactggtatggcaggaagctgccgaaacatgcacacggaaccgctaatctgaagcagcatacttcttcatcgaggctgatgacacaggcggttgtaaagctgtatcatgaaattgtgaatccggatcttctgatccgccggattacgatggcagcgaatcatgtgatcagtgagaaagaggtccaggaagaacagcagtatgaacagatgaatctttttacagattttggaattgcaaagaaggaaaaggaagagaagaatgagaagctggaacgggaaaagaagatgcagaaagcgatgctggacattaagaaaaaatatggaaagaatgcaatcttaaaaggaatgaatctgcaggaggatggaactgcgatggaacggaaccggcagatcggaggacataaagcgtgaggaatgataatgttttgaaagaaaatgttacacaggtttcggggaaattacagaaatcggtgatcgaagtgcagcaaaagtatggagatattctgaaccttccgcatcatgtatcggagacacatccgccgatgccgatagcagaccgggcggctcagtttgcaccatttgcggcactgaccggctataaagaagcgatagaagagacagagcggctggcagagaaaaaaatcgagcgggaatacgagtaaaggcaaaaaatggaagaaaaatatggtgaatctcttgaccttcaagcggcttgaaggaatataatcatcttaacaaagagggagaaggatgtagatatccggaatgagggaaggtgacagtatggaaaaaagtgaagaaagaaacaaaatcatttctgaacttcagacagtaataaaagaacaggttgaattaaaagaaatcgaaataccgggaaccattacatttcaggttatgtctgtggatggtgggaatgtaccggtgggagccggtgaagtgcttctgcttcgttacagtgcgactcatctggaatacagtcatgagttggaagacgagaaccagaagtttcatatggcagttcatatcatttattgtaaagagcagaaaggtttatttggtaaagtaaaatacaagacgataaaacaccgcaaagagatcattacagaggcagactggaagaatggaaagaaggtgtcactttatgaagattaaagatgtagaaaaacaggttgggatttccaaggcgaatataagattttatgaagaagaaggactgatccatccggcacgtaatcaggaaaataattaccgggagtattcagaaacagatgtagaacagcttcaggaaattaaaaagctgcgtctgatcggtattccggtacaggagatcaaagatatctatgaaaatagattgactttacaggaagcattatctcacagattagatgagatcgaaaaagaagaacgaacattaaaagagacaaaattgacctgtcagaaggcattgaaaagtaagcttgacattacatcgatcgatcagcttgagattgaggaagaaaaagaagagtggcaggtacgtctggcaattcttttgaaagaggatattgtacagaagaaattaagcagggatgagatgaacaatgagattgcatgcttttttattgcaggaacgatcttaagtgtgatatctatatggctgctcccgaaggattatattggaacacatctttatgttggaatgatttcacttgcagctgtggttggtctgtttatcataggaacatgttcggcgaatatgaaagtgcatctgacattgttgcttctgggggcagttgtacagcctgtcggattttttacaatcggaacattgatgggaagaggatatattgtgtgtcgtgatacagcggtattgaagcagtatgtaatctacctgtatggcggggcatttattcttgcaattatattgtggatgggctcaaagctgaaccgctatatcctgaacaaactctggatcagtatgcttgcaagcctgatcatggcaggagtgatagcacagatgctgaatcagaagtatgaccatttgatggcaacaggcgaacttatcgtgggatttttgtgtgctgttatttatcttgctgctgtatccggaacatggacactggcgaatgcagactggggaaaatataaccggtatcatgcagtgtatacgtcgaacaagatgatcaatgtattcgcaacgatattcaatgcagccggatactatagtggaaagaactggaggagatagcagatatgaattatattacatttaatgagattattgaagtgaacggattgctggaagagaaagggctgaattttaaggttcacttgagagatgcctgtggaaaacagtcctgttggatcgaaccgttaggaaactgtgcatgcgagggacggtatgaggagatgtatcaggttgtggaggagtattttagaaggaaagggcagaagattgcgtttgatgagacgaagttgaatttttttgctgtttaatacagtattgtggcttaccccaagtctttctcatgtcgtgactggccaatgatactgaattcaatagcggaattgtaacctgtgtatggccgaaaagttgtggcggaagccttgactttccggctttttttgtgcacttccggtatcacagcagttatggttccgctgttgaatcattacagcatgcgatacccacggaatgaccgcttcatgtaataaacagcaacaaaatttgtttgaaaatatattgaataatatttatttgtatgttaatctatataaaagcatacttcaaaagaaatctaaggtatattgaatcatatactatctacattctaattgcatttcaggaatctatgttttttataccaatcaattgtaaaaagcaggagaggactgaacgtgtaagtaagatatcctcctgcacataggaggaattaaatatggcgagaagaaaaagtcagaagagacgtaacaaaaagtatcaggtaagcaaccgtcagttaaaggcaaaacggccatacaaagatacgatttttcgaatgttgtatcatgataaagaaaatctgctatcattgtataatgcagtgaatggtcggaattatactaatgtagaagatttgcagattgtcacattagaaaatgcaatttatatgggaatgaaaaatgatctggcgtttattatggatatgaatttatatttgtatgagcaccagtcgacgtataacccgaatattccgcttagaaatttattctatattgcggatgaatatcaaagattagtagttcggaaatctttatattccacggtaatacaaaagataccgacaccaagatttattgtattttataatggaacgaaaaaggtagacgattataatgaattccgattatcttcagcttatgagaatccgacggatgatccggatctggaattaaaggtgactatgttgaatgtaaatgatggtcataacctagaactgatggaacactgcagaacattaaaggaatatgcccaatatgttgcaaaggtaagaaaatatgtgtcgaagaatatttctctggaagaggcagttacgcgagcggtagatgaatgcatagaggaaggaattctggcagaatttttggtgaagaataaggcagaggtgatcaaagtgagcatctatgagtatgataaagaatttgaagagaaaaaattacggaaagcggagtatgaagctggtgtggaggctggagtagaatctggaattgagcttggagaacggagtcttttgaaaaagcagattaaaaagaagttgaaaaaaagaaagtctataggacaaattgcggatgaattggaggaagaggtaactgcaattcaacgaattatagaagaaatacacaaagaagaataagtatatgattaggaaggctgttgcattgcaagagtcttcttttactattcaaagctttttaccttaaaattaaaaaagtaaaggattcgtcgattgacgtatttaacaaaaaatgtatatgatgtaattaaacaaagaagtctattcggtttcgaagaacggaaaaaggaagtgaattacatggatgcaaaagtatttggaaaatttatcatggaacggagaaagcagctgggtatgacacaggcggaactggcagaaaagataaatgtaacggataaggcagtcagcagatgggaaagaggacttggttttccagacattaatacgttagaaccattggcagatgcactcgggatagaagtggtggagcttatgagatcggaaatcaatacagaaagaagagaaactgctgtagatcggaagaacgtagtagagattatgaaatcaacggcagagatatcggagtatcatgcggcaaagaaaatgaaatggttaatcagtggaattagctttgtaatggcagtattaggtgtaatggttacacagtcaacaaaagtgttttcttcgattgcattttatggctgtatcataggatgtactacatgtgtggttcttttacggcaatattgggaaattcgtgaaaaaagggaattttatttttcacttatctggtgtctgtgggcagccagtctgatatggatgttccagttgttttcgataaaagcaataaacagtatcatggatgtggggagcattcttattggtagtgtgattgattttatatttttaaaagattttattgaaagtgtaattaagaaaaaatatctgcaaatggcagtgtgtggaatatttcttctttcaacgacagtagaatattttcggattgtattaaagtaataaatacatttattaattctcgtgttgctttcttgaaaaatataagttaaacttataataaataaaattttacagagagaatgaggaaaagtcatggaaagcaacaaagaagaaaagataaagacggtcagtgaagagaatatctataagctgaacggaagagttccacttaaaaaagccattccgttcggcttacagcatgtactggcgatgttcgtatcgaatttggctccggtactgatcgtgtgtagtgcggcagtacttagaagtaatggggcacatttaagttcggcggagattacacagttattgcagtgtgcgatgtttgtagccggaatcggaacctgtttacagttatatccaataggagtgatcggatccggacttccgattattatgggagtcagttttacgtttcttggaagtctgttggtcattgcaacgaacccggatcttggatatgaagctatggcaggtgcggttattttaggcggtatttttgaaggttttgtcggactgagtgccaagtactggagaaaatatctgactccggttgtatcggcttgtgtagttatcgcgattggattgtcacttctgccggtaggtatggattcctggggcggtggaagcggagtgaaagactttggttcctggtatcatctggtcgttggagcatttacattgatcgtgtgtctggtatccagagaagtactgaaaggcgtatataagaatttaaatgtgctggttggactggtatttggttatgtacttgcaattatatttactgtagcgggaatcgcaccgatggttgacttttcggggattcataagacaattcaggaggttggtgtgttcagtatcccgaagcttgtgttcctgaccagtcataaaccggtattcaatctgggagcatttttcacgatcgcaatcgtattcctggtatcggcagcagagacgacaggtgcaacgacggcagtctgtacgggagcacttggacgtgatcttaagatgaaagaacttcgcggttcactggcagttgatggattttccagtgcaatttcgggatgttttggttgtctgccgctgacatcattcagtcagaatatcggacttgtgacaatgacacaggtgattaaccgttttacaattttgatgggagcgttgattctgatccttgcgtcgttatttccaccgcttggagcattcttcaattcacttccacaggcagtgcttggcggatgtacggttatgatgtttggatcgatcatgtatgaaggaatcaagatgctgaaagaatgcaaattcgatgatagaacaatgattatcgtgtcactgtcatttagtatcggagttggtctgacacagacatccgggaacttctttgcagcatttccaagtgcggtaggagatgtatttaatggaaatgcggtggcaggagtgttcgtggtatcgctgcttttgagtctgtttttgccgaagaagacgaaggtggagtagaagagaagatacaacaatagaataataaagaaaaaagattatctggagaaaaatatctggataatctttttttcattatgcgtttatatgtttcagttatgatttatatcggttaaagctttttgatagaagaagcagagatataaacccaattgttcctaagtttaaatttagcccaattgttagaaattgacactactaagataatgtttccttttttgacggtgccggcagaagaatagttatttcctggtccggtgcgtaaggtggcttgggcagatgtgacgacatatttggttgtgtgaagactacggtcactggaatccgctaaattatcttccgaagattgtgagggaggtaaagataattttgaataagcagtagcagcataagtggtagaacaaaaagttatacttattgtaattccagcaataataaaaaatagtgtttgtttaagaaatttcatttacaacgctcctccttagtatttgataatttatactttacagatcaattcttaaatatgggattaaaaaatctgaaaaattcttaattttttctgggtattatgatttgtatgttatgatttgaacagtagaatgtgtagaaggagtggaatatatgaatcatattttaattattgaagatgatccggatatccgggagagtctcagaatattgttggaatctgaaaattttttgataacagaagcaaaaaacggttcagacggacttaataaattttccgcagaaataaaccttgtaatattggacattatgatgcctggaatatcaggtattcaaacttgtgaagaaataagaaaaagatcagttgttccaattctttttttaacagcaaaattaagtgaggaagataagattacgggattaacagcgggagcggatgattatttggtaaaaccattttcagcggcagaattacttgcaagaattcatgcgttgttacgaagacatcaggtatatgataccgaatttcatagagattcccaaaaagaggaatggattgaaaggcatgggatagttattagcagcgtgtataatgatgtgtatatgggagaaaaagaactgtgtttgacagatatagaatatagaatcttattattgctgatgaaatatccaggaaaaatattttctatacaaaatttatatgaaagtgtatggcaggaaccattttacaaggcatcggctaatacgattatggtacatatcagaaaattaaggtcaaaaatagaagaagatccacaaaatccaaaaataataagaactgtatggggaaaggggtatacatttggttaaagtaaaaaatgccaatcttacagttaaaatgttactattacttttgaaaggaattttaataggaagtattgtttttatattattatattttggtggtagtcatgtattaatgaactactattatgaatccgattatatatataaggcggaaacaccttatgtgaagcgtctgcaaaaatatgttactgaaaatcatgtggcagctacagactctgaaaaattgaaaaaatggtcaaataagcagaagatttcatatttttcagtttcaagagaaagaaaaatattatttgataatttttatgtagaagccaatttattaaagccagtagaaaatgacatgttgaattatacctggtattttttgcaaaatgtaaaattcgaagatggtgatgcggatgtatatatttatgcggattatgaagtgaagataaaactcttttttatatttacgattactgcaatcagctttggaatatgttttgttgtatttatttttggaataagaaaagaagtgaaatatatacaaaagttaagtgaatctatccagcaaatagagggcggatattgggatgccgatatagaggtgagaggaaaagacgaactgggaaatctcgcctacggattggatcagatgcgcaagactttgataaaaaaagaagaaaatgaaaagcagatgaaagagtatcaaagtaaattggtgcttgcgatggcgcatgaccttcggacgccattgacaagtctgattacttttttagaaattgcaataaagaaatcaacaaataatgagaatcaggaatatatacaaaagagctatcaaaaagcaaatcagatcagggaactgacagatcagttgttcgatttctttttgattcaaaagcaggaaaaaatagaattagatccaccggcaaatgtggaatatgcattgggggaatatctatcagaattttgcgcatttgttgaagcagaagggtatcaagtgattgttaaaaatatggaatggggtgaagcaaaagtacaggtttaccatagatatataggacgtattatggataatctggtttcaaatataaaaaaatatgcggataaagagtacccaattattttggagatgaagaataatgaaaatatgatacagatagattttgaaaatcaaaaaaatactaaaaaagagtatgtaaaaggaacgggaataggaatacagaatataaaaaatatgatggagcagatgaaaggagaatctgaaattataaataatgaaaacagatatgcaattgttttaagttttccgatatatatagaataagatactgcgaaaaccgcctgttagaaattaagaattattcagatttgttaagaagcaggataagatttattgggtatagtaagggtaagtaaatcgagttgttttggtgtatttggaaaaaggaatcataccattttactgaattgagaaaatggacaattatagtttcatggtagaaattatttttggcaaagtttgtggttgattttctttttgtgaatactgtgaatgaccgtttttgtgcttttattatacatggaatagagcaaaattacgaatttgctcgtttgtagggtagggggaacgaatatgaagaaaaaaatattcttttatgcttgctttttattaattggttgttttataggcatcaacattaaggaatttaaatcgaaatatgtagatgcatcagaagaggaaaaaggactatacataaagtatggagagcggtttccaatcgaaacattcaatgcattgggggaaaagaaaaatcaaaaacatggtaatacacctttatataaaatctggttatatattgatccgaattgtgaaagttgtattgaaaaatttccggtggtagaaaggctaacggaaattatgcaaggagaaaatatagaaatagatatcttatggagacaagaaccgaaaaaaacattagtagatactttagatatttcaaaggataaacaatataggactggttcaattaaagtgttaaatgaatatccaacatattttattaccgatgaagaaaatagcgtacaaatgattagtgatgatattgataaaattgtgaaaaagatgttgagcttagatgaaatagaaaaaaatgcaataataaaagaaactaatatatatttaaagaaattaatagggcagaacgacaaacaaaaacagaaattggtatattttgcaatggatgattgtccagattgtcaaaatgtagaaaaattattaaatgataatagtatagcttcaaaatacgacatgataacgatatatacagtagattcaaaaggagaaaaagaatgtgttgatgaaggtgaagttttaaaaaatatatatgatatagattggtatccaagctttttgatactagacggagacaaatatgaatttataggacaagagtcggatgaaaaacttcttgaaaaattgaaagatggtattacctaaaaacatatagagaatggcaccctgccaatactaagaagggagtagacctatgaagagtattagaaaaaaattttttgtgatgttattatcggcaatgttattactgggaattagttcaaatgtgcaggcagcaggttgttcagattataagaggatatcaacagggactgcgaaatgtacaaataatttatgcccgggaggttttaaaagaaaggaaagacaagatttatatcaacaaacatgtgtaagggcaaacggaacactttattataatcaaaagtataagaatgtatatgtaaattgtagctgtacgtaaaatcttaaaaagtaatgtagaaataattaagtgataactggcagggtgttattaacgagagacaaagaagaggtgagaattgtgaaaaggagaatatttataatcgctattatggggagtttgcttttctgtttgagtggatgccaacacaaaaagagtgaaaattataatattatgcttaattctaaaagtgatgtattacctatttatgcagagaacgataaggagataagtaataaaacatcagatttagcgtctcttgaagatgtcgatgcgggatataatgtagaagagtggaaatgtgaaaatgagccaaatggaatcatatgcctggaagattcgataatgatttcggataaagcaagtgatgctattatacaaatggattattctggaaatctaattaaaaaaattggaaagactggtaatggagaaggggagtttttatctccaggtgcaattaaagaatataatcatgaaatatatgttcttgatcaaggaaataatagagttcagatatttgatgagcagttaaattatgtagataaagtagatttgataaacaaaaaaataaatgatccagattatgttccacaaaaaatggcagtaaacgaagagggaatatacgttacgggaatgtcattaaaagaggcggtaatagataaatatagcaatggagatgaagaagaaataggagcaaattttatcggatcaattgcaagttatcaatcagaaatatatggaataaattccatggtacggttttatgataagaaaaatgatagctttggagcggtcaccacagcacctgagtggcttttgtctgttagtgggaacaagttaaaaaaggtatctgaattaccatatggatttgggataactgattttctgattgaagacaagaaaataatatgtatttctggatcgggagcatcggtatattcattgggatggaatggggagtataaggaaactcttgcaatcatttcaggactggaaaatgaagaaaatccgcaaatagatgaaaacaatcagggagagtactttatagttatgccgaaagcaaaaaaaatataccgaatttataaaaagtaaggggaaatgtatgaaacggtacttatatatagggtatcaaacctggataaaaatcaaataccaaaagaaaagatacttcttatatattctttcgttttatgtaggtcttttgcttccagcattctgtttggctaatataagatcggtagacagagtgttctattttacgacatttaaaaaaatgaatagttcggtgcagattgattggtttagtgaaaaatttgatattctttttccagaaggaatggagtattcgataaaagcatataaagaagagaattttaaacaatggggggataaatatgtttctataataggaatagatgaaaaatatgcttatccaatgcctgatattaatggaaggatgttcaataaaagggaaatgaagactggtgcagcagtatgcttggttgatggtcaatgtgctaaaacatattcttataaagttggagatggtattttaatccgagataaaaagtgtaagattgtaggtatattgaacagcagcatatattcgggaattgtaatcccgtatcagacaatgaaggatatatatcagaacaaagaaaagatacaatttacaggaactttttggggagaaagtaataatttagaaaaaattgcagataagggaacaaagatcattgaaaaaaatgatccgaaatcggagcttatatcaacaactacaggaatggaattatataaaaatgcattgacaacaaaaaaacaatggagaattgtccggggacttattgcaatggttgcactcactttttttgcattaaatgaatctatcgtacttatagaaaagagggacgaagagcagggaacggtaggaatcaaattggcactgggagcttccaggaaagagatgcggatagaggcacttttggaaactttttggattacaggaattgcagtgctgttagtaattgttacgatgaatccactggccagaatgcttcaattagataatgttatcgtggtggatggagtgattattgtggaaatgattacgatatcgttgttaacctgtggaatattagcaagatgttcgataaagaaaataaagctatatccaattgcattaatgttgaaaatgaaggagacagagtgagctatattataagaagagcatggcaacggttaaaatggaataaatggatctcaatattgatgattattgagatgatattaggaatgagtgtgttggtatatgcaatgaatatgtattcttcactagtaaaggaagaaagaagaagagcaaaccaaagtcgagatttatgtcttgagatatctggatttaatgaaaaaatgttatcagagacagtagcgttgacgattcaagattatgaaaagatacagaaaatatcgagtgggaaaacctttttctatattgccttaccagaattttacgtagcaaatgataaaaattatgagtttacaatgattttagcggattatgataaattaggattaaagaaaggctattgctattggggaagcaataaagaaagtatcgaagatatatttacgatttctgaaatggttccaaggaaaatgccgacacggataaatgagcaatcatggaagacagaagtggagaatatagaactgaagaattgtgtaattgttcctgttgaatatatggaacagatagaacaaaaaatagaaccggcatacattcatatggaatggaattctaaggaattagaaaataaagatcagatgttaaagaatatagaagagtatttaaataaaatgcatggagaagtatattcttaccgtatctattctccggaaatagacttaaagaataatggatataaagtgaagcaatcgatacgggtaatcatgcaggctggtattttatttttaatagcttttttgggagggatgatatcaattttcgaattattatttaaccatagaaaaaaagcatacgggattagtcttgcgtgtggagcggattataggacggtattttatgaaatgtttgcagaggttgctttattgaatgggataggaatgttcataggaataggtattggctacatagttacatactttgttgatatgggaattatgatcggttatataaaagtagaagggagtatcgtgtcattcattgcaagtataagtgtttatttgttaataactattattgtgtctggaaagagttatataaaaataaaacaaagaaaagtgattgagcttttaaatggggattagaaaaagaaaatgattgtactaaaagatataaaaaaaacatattatggaaaaaatatagaaaccaatgtgttgaaaggtgtagatttgatgattcatccgggagaatttgtttgtatttatgggagctcaggaagtggaaaatcaacattgttaaatattgtgggggtattagattatgcaaccgaaggggaatacacattggatgggatatctattaaaaatttgaatgataaaaaaatggcagaaatcagaaaccggaaaattggatttgtttttcaggcgtatcatttagttcaggaaatgaatgttttggaaaatattgctgtcccacttggatatgcaggaatgtctaaaaagaatagaactgcaagagcacaggaattattggatgaattccatatgaaaggtttagaaaaaaagtatccggcgcagttgtctggtggagaacaacagagagtttctattatgcgtgcaatttccaatagaccgcagattctcttggcggatgaaccgactggaaatctggatagtgacaattctagaatggttatggagattttatctcgtctgaataaggaaggaatgacaattataatggtgacgcatgatttgtcactggcgaaatatgggacaagaatcatttatattaaggatgggaaaatagaagagcatgaatagtaaagaaagggaatgatgacaaaatgaaattactggcaaaaacgagcaatcctgtggaatgcgaaaacataaaaacaattttatcatcacaaaaaataacatatcggatagatgttagaaacaaaaataatatgtttaaatttgtaacattgctatttataacaggatcaggagattttggatttagagaaaatgaaggaaaaaagtattatatttttgtgggaaataaggattaccaaaaagcaacagaagcgttaaggcaatatagtaaacaggtgaacgtatgaaaaaattagataatatagtaggaatcgcattagtttcttggggaatgatgttgcttttcattgtaatgtggttaggaaataagtatcctgagatacaacaggatttactcctgatagttagagtgtatataggcctagtgacagtctttgtaatatccaggattatttttaggataacgaggaggagaaaaagtgaacattcataaaaaaatgaaagcgttaaaaagaaatgctatattgctattactatatgatttgctggtgttatgtattgcgtttgtaaaaaatggaatgacaaatatgtcagcagaagcggttacgtcactaattgtatctattggttttggaatattcatcaatttactctggatcgtggattccaaaacctggattactgattacggaaaaaggaaatgtatctggtcctattggtgtggcgaaattgtacttctgctgttagtagttgctttggaaaatatgaatcaactggttgcaacatctgccatattaggaatgatggcggtatatcttataattggtatatggtgggtgaaccgtaagctctaatgtgctaatgctcaccacacacatccagaaattcctgcaccagcggcactggtttctttcctttcgcccagatcagaagaatcttggttacaagatccggctcatccaattcttgtatacaaagtccgtcacacaagcttgccatggactgtggaaagatggcagttgcaagattttcctttgcccagagcattgcacctctcggatcgtcgcagacacagaagatgtccggattcatattctgggcatgaaaggtattcatgatgagttcttcgtatcttcggtataagattaatggtctgtgtagaagatcagcgagttttaaggaagaggcagcattttccggtgccgataccgcgatcatcggctcagaacacaattccatataagacacctcgtcaagacgcagtggtgttctggcaacggagatatcgatgatcccgtccagaagatactgataaagcgaataagtgatcccgtcgtggacttcaaagttcacgtcgggattttttttcgaaaactgggaaatataaggcatgatggtatctaccgttgtcggagtcaggccgatacgtaagatacgttttttgccggtttttgagacttccagttcggtagaccttgcgtattccagcaggttaccggagcggtcgtagagaagcttgccggcttcagtcagggtaacacccttgctggtgcggtcgaaaagttttacatttaattcattttccagctggcggatctgatagctgagcggcggctgggacatgtttaagtgtcttgcagcttcgttgatgctgccggtggatgcaatctcgcggaaatattctaactgtctgagttccatgttggattaccttccttatatattttttgtattgcaaagctataaaaacaatattattcatatcaatgataacggactataataaaacagtcaagggacattatgaataagtagataacagatgatttattagttatcggatagaaaaaggaatggagtgaaagaaatgaagcgtcttgagaaatttctgagaccataccgcagggaaagtatcctggcaccgctttttaaattgctggaagtggtattcgatcttatggttccggttgtggtagctcagatcattgatgtgggcgttgcgaagaatgaccgtggatatattgtggaaatgttcttcgtattactgcttatggcagcagtcggactgttgtgcagctttaccgcacagttttttgccgcaaaggcgagtgttggatttgcgaccagtgtcagacaggcaatgttcgaccatatccagagactgtcatttacagaactggatacgctcggaacggatacgctgatcacaagactgacagacgatgtgaaccaggtgcagaatggaattaatatgggactgcgtctgttgctgagaagcccgtttgttgtgatcggtgcgatggtgatggcatttaccatcaatgtgcgctgcgcactgatctttgtcgtgacagtgccaatcctgtttgtagttgtattttccattatgctgatcagtattccgctgttcaagaaagtacaggcaggactggaccgtgtgacaggacttacaagagagaatttgacaggtgtccgtgtcatccgtgcgttctgcagggaagaacagtcggtggaggaattcgaagaaggaaaccgtgaacttacgagactgaatgaattcgtaggaagaatttctgctcttctgaatccgctcacgtatgtactgattaacgtggcaactgtgttactgatcgcgcgtgccggagtgcaggtgaatatcgggaatctgcaacaggggcaggtggtagcactgtataactatatggcgcagatcatcgtagagctgatcaagctggcatctttgatcattacgttgaataaatcaatggcgtgtgcagaccgtgtggctggtatcctggatgtgaagtccagtatggaatacaaagcagtggctggaaatgataaagctgatgataatatggcagttgagttcaaccacgtcaccttcacatacgaaggtgccggagcatccagcttatcagacatcaccttccgggcgaagaaaggacagacgattggaatcatcggcggaaccggaagtggtaagagtacactggtcagcctgattccgagattctatgatccacaggaaggtatagtaaaggtaaatggcgtcaatgcaaaggattatccgcagggagaactttgccgtgagatcggagtggttcagcagcgttccatcctgttcaaaggaagtatccgtgataatctaaagtggggcaatgatcaggcttcagatgaagatctgtggaaagcgatcacaatcgctcaggcaaaagatgttgtagaagctaagcctggaaagcttgattttgaagtggaacagaacggacgcaacctgtccggaggacagaaacagcgtcttacgatcgcgcgtgcactggtcagcaagccggatatcctgatactggatgacagtttaagtgcactggattttgcgacagacgcagcgcttcgtaaagcaatcggtgaactggaaggcaatgtgacaacattcctggtatcccagagaatttccggcatccggcaggcggacaagatcctagttatggacgacggtgaactggcaggacagggaacacacgaagaactgatggaaacttgtgagacctatcaggaaatctattattcacagttcccggaagaacgtccggttgtaatgaagacttctgagaagacagagaaaggagcggcagagtaatgaagaaattattaaagctcatagggaaatataagattttccttggattcagtgtcatctttgctgcgatctctgtagtattgcagttgtatgtgccggtcttattcggagatgcgatcgatgaagtggtagcagcacatcaggtgaactttgatatgatgtggtattatctgagacagattctggtattcatcgtgatatcggcacttgctacctggttcatgaatctgttgaacaaccgtatgacttaccggatcgtacaggatatccgttcacaggcgatccgccacatccaggtattgccgttatcttatctggatcagcatagtaccggagatatcgtaagccgtgtcattgcagatacagatatcttatccgatggtttgctgcttggatttacacagctgttttccggaattgtgacgatcgttgtgacgctgatcttcatgttctccaagaatgtgtgggtaacgcttttagtgatcgttctgacaccatttagtttcgtagtagcgaaattcatttcttccagatcttatacgatgttccggaagcagagcgagacccgaggacgccagactgcactgatcgaagaaatgatcggcggacagaaggtagtcaaagcattcggttacgagaaagaatcatccagaagatttgatgagatcaataaagaactgcagacatacagccagaaagcggtattctacagcagtttaacaaacccatctacacgatttgtcaacaatatcatttacgccggagtagcactactcggagcttttctgataccgggcggaacgctgacggttggaggactttctgtactgttatcctatgcgaaccagtatatgaagccgtttaatgatatcagttcggtaattacagagatgcagaatgcgctggcatgtgcggaccgtatctttgacctgttggagcagaaagaagagacaccggatgcagaaggagtatttgctacagtcgatggcaatgttacaattggtgatgtggcattcagttatgataaagaaaaagaactgattaagaatttcaatctggatgtaaaaccaggtatgcgtatcgcaatcgttggtccgaccggatgcggtaagacgacatttattaacctgctgatgcgtttctatgacgtagatgaaggaaagatcctggtggatggaaaagacatccgggaagtatccagacatgcgctcagaagcagctttggcatggtactgcaggatacctggatcaagagcggaaccgtgagagacaacatctgttttggaaagccggatgcaactgatgaagagatcatctgtgcggcgaaagaagcaagaagctgggaattcatccgcagacttccgaaaggtctggatacggtgctccatgaagacagcatcagccagggacagaaacagcttctgtgtatcacaagagtcatgctctgtctgccgccgatgctgatcttagacgaggcgacatcaagtattgatacccgtaccgaactgcaggtacaggaagcatttgataaactgatgaagggcagaacaagctttatcgtagcacacagactttccacgatacggaatgcttcgttaatcttagttatgaaagacggtaagatcatcgagcagggcaatcatgaagaactgctgaaaaaaggtggattttaccataaactgtatcacagccagtttgaaagttaatatatcaatgtaacataagtgaggccggagttttttgaaatctccggcctcacttataatgcacagtatgaatttttgcggtataatacaattacagtataatgaaaacagggagaataagcatggattttagaaaagattttgtatggggagcagcaacaagtgcatatcagatagaaggtgccgtgaaagaagacggaaaaggcgagcatatatgggatgtgtatacaaaggaaccggggaagatattcgaaggacatacgggagaagtagcatgtgatcattatcacagatataaagaagacgttcggattatgaaagagattggactgaaaggatatcgtttttcgataaactggtccagggttatgccggaaggagctggcagggtgaacgaagccggcattgcattctacaatgatctgatcgatgaattattaaaaaatgatattgaaccatatattaccatgtatcactgggaacttccatatgaattgtataaacgcggtggatggatgaatccaaagatcgtggagtggttcggagaatatgcaaagcttctggcggaacgattcagtgacagagtcacacatttctttacgttgaatgaaccacagtgctttgtcggactcggttttgtaaatggcgaacatgcgccggggataaaagcaccgatccgggatacttttgagatggcacataacgttatgaaagcgcatggaagagctgtgcagatgttaagaacacatgggaagcagccacttgtgatcggatatgcaccgacagcttctgtatgctatccggcaacggaaaaagcagaagatatagaagcggcaaagaagagtttctttgctctgccggatgagttctcaaactggcactggaatgtgacctggtggtcagatccggttcttcttggaaaatatccggaagaaggtctggcgaagtatgagccatatcttcctaagatcacagaagaagatatgcgcctgatctcacagccgatcgatatatatggacagaatatatataatggatattgtgtgcggatgggagaagacggaaggtcggaaacagtaagccgctatgaaggattcccaaaaacagcgattgactggccggtaacaccagagtgtctgtactggggaccgaaattcctttatgaacgttatcagaagccaatctatattacagagaatggtctgtcatgccatgatgtgatctcactggatggaaaagtacatgatccgaacagaattgattttctggcaagatacctgcatgaattaaaaaaggcagcaggagagattgatctgagagggtacttccagtggtcactgatggataactttgaatgggcaaaaggttattctgagagattcggactggtatatgtagactatccgacacagaagaggatcttgaaagattccgcttactggtatcagaaaataattaaagagaatggaagtacattataacagggggagtaaatgtcagatgacgatcaaagaaattgccaaactggcaggggtatccagcgcagcagtatcaagatatctgaatggtggatatgtaagtgacgagaagaaagaacagattaaaaaagtgatcgaagagacgggatatcagccgtcggcacaggcacgtatgcttcggacaaagaaagcctgcctgatcggagtggtcgtgccgaagattaactctgaatcaatcagccggatcacagctggaattgaaaaagttctttcagagcgtaattaccagatgctgcttgcaggaacggataatacaccggtgaaggaaatagaatatatgcgtctgtttgagaattatccggtagacgggattattcttgtgggtacgatgatcacagcagagcacagaagatttctgaaaaaatccaaggttcctgttgtcgtgatcggacaacatacaaagtatgcaaattgcatttatcatgatgattacggtgcaggagaggccatgggacgtgcggttgcggcgaagagcaggaaagagattgcgtatatcggagtttcaagagaagacaaggcagccggagcagccagagaagatggattccgggaaggtctgaaaaggtcgggacgggaattaaaagacggatattataaggtggcggagttcactacagagtccggatacgagaaagttctggaattgttgaatgaaaagaatgacatcgatatcatatcgtgcgccacagatacgattgcggccggagcaattgaagcgattcatacttatgtaggaagtcagataccgaagaatgtggaagatacgggttccagattccgttatatattggaaaatacagcaatccaggttacgggatttggtgataatcagcttttaaaggcagtaaccggtggaattccaactgtacatttcggttttaaaaccagtggtatcaggggtgcagaactcttgttggatgtgatagaacggggcgaaaatattccgatggagatcaaacttggatttcggcttgctgaaattgatgatccggaagaaaatatagaagaataagagctgccggagtagaaaatcagtgtataatacgtgtaaataaattcgaaatcggtcaaaaacaactaaattcgtgcaatacgcacaaaaatgaatatgaaatatcagtaaaaatgccatctttacaaatggcattttttttcttattataaaatcatacgatgtgaaaacgattacacatcaaatgaggaaggagagttattatggattacagaaagaccgcacaggatatcctggatcatgtcggtggaagtaataacattgcatctgcagcacattgtgcaacgagactgcgtcttgtcattgcagacaataagaaacattgcatatacatttctgcagatcctgattgcattctcagcagcgaaagcgtttggtgctaaccagtatcttggcgcagttatcggtatgatcatgatccatccgtcactgcagaacgcttatacggtagcaaccgaaggtgtacagcagacacagagcgtattcttcggactgttcaagattgacatggtcggatatcagggacatgtcattccggttatcatcgccgtatggatcctggcagtgatcgagaagaagttacataagattgttccggaagtgctcgacttattcgtgactcctctggtcagcgtcttcgtaacaggttaccttacattatcaatcgtagggccaatctttgtatgggctgaaaatgcaatcctcggagcaatccagtggatgttaacacttcctcttggaatcggaagtctgatcatgggaagtctgtacgcaccaaccgtagtaaccggtatccaccagatgtatacagcaattgatatcggacagattgcaaaatacggtgttacatactggcttccgcttgcaagtgcagcaaacgtagcacagggagcagcagcattagcagtaggtatcaaatctaaagataagaagatcaaatctctggcacttccgtcatcactcagtgcatttatgggaattacagagccggcgatcttcggtgtaaacttaagattcttcaagccgttcatcgccggatgtatcggtggaggatgtggagctttgtatgcatccctggtacatctcggagctaagggaaccggtgtgacaggtatcttcggtatcctgctctgcctgaatcagccgcttcagtatctgatcgagatggtgatcgcagttggtgttgcattcgcaatctcattcgtaatctataaggatgcagaaccaaaggcagtaacggcagatgtgacagagacaactggaacaacagagacagtagaaaatatcgaaatagcagacaacaataaagcagaagagacattgacaagtccggtaaatggaacacagatttcattatctgaggttgtggatgagacatttgcatccgaaatgctgggaacaaccgttgcggtagagcctgcagatggcaagattgtagctccatgtgacggagaagtttccaatattttcgaaacaggtcatgctgtatgtatcacaacagagtccggaggtgagctcctgatccatatcggtatcgataccgtgaagatggatggaaaaggatttacgaagaaagtttctgatggcgacaaagtacatgcaggggatattctggtagaagcaaatcttgaggaaatcaagaatgcaggatatcagacgacaaccatgataattctgacaaatacagatgaatttggaaatgtaacaaaggcagaacctgctgaagttaaaacaacaagtaaagttatgacacttacaaagtaatgcttatagatggagaagattgatttatgaacgcattaacaagagatcttgcgaaattagtagagacagcagaacaaagccagaaaaccagagaagagttatccgtatcagatagaaaatttcgtgaaaaactacacctgatgccgccggttggctggctgaatgatccaaatggactctgccagttccagggtatctatcacgcattttttcagtattcgccatttgatgcggaaggcggcgtgaagatgtggggacattacaccagcacgaacatgattgactgggaatatcagggtgccgcactttatccggatcagccgtttgactgtcacggggtatattccggatccgcatttatcgaagatggaaaaatgtatctgtactatacaggaaatgtcaaattagaagacggggaatatgattacattcgaaccggacgtgagggcaatacggttctggttatgacagaagatggaaagacatttggcagaaaaaaagaactgatgcgcaattccgattatccggacgatctgacctgtcatgtgagagaccccaaggtatggaaagaaaatgatacctattatatggtacagggagcaagaacaaatgaagacgttggacaggtgctggtattcgaatcagaagacaagataaactggaaattcagaaaccggatagaatcggaaaatccattcggttatatgtgggagtgtccggattactttgagattggtacgaagaagcttctttctacatcggtccaggggctggaaggcggtatctgggatgactgcaatgtatatcagtccggatattttgagatagaaggagatattcttggagaatataagctgtcagaatatcacttatgggattatggatttgattattatgcaccgcagagctttgagacagaagacggacgaagaattcacatcagctggatgggaatgccggactgtgaagagtatacaaatccgacgattcagacgggatggcagcactgctttacatttccgagagaaatcttcgagaaaaatggaaagatctgtcagtgcccgattcgtgaactggatgagaagaaacatctggtaagtgatgtaaaaggtatgctgtccagtgacggttatccggtgtatgaactggagattttgaatattgcagaaaaccattttaaagtcatcctgtcgaatgaactgatcctggattatgcagacggaagattccggatgtattttataagtcaggacaagacttctgtatctgcaggacgaagcatgcgttatgtggaagtggatgaagtgaaggatctgaagattctggctgatagatcatcggtagaagtatttgtgaatgatggagagtatgtattttcgacaagatattatccggaaaatcataaattactggcagaagctgtggaagcacagattagattgtcagaaattatgtaacgaaatatgaatttaagatacgaatcattatagaaagaaaatcaccatatatcaaaaggaaaaatttcagtagagaaattttatcgggatatatggtgatttttcttaatgtaagagatataaatatttttcgaagttaactccttcgtttacagggacctgttcttttacggaatcagctaatgctttttcgagaaaagatccggcagtctgcatcatttctgtaagggaagttccgcgggcaagtccacctgtgatacaggaggcaaagagatcgccggtaccggaatagcttccatcgcagcagggaaatgccgacagaaaatgcgaagagccgtctaacaggagattcccaatcttagggattccatcatctgtagtaaagcgaattcctgtgataaggatctttttcgtacgttctgctgttaatgtatggcttgcatctttgaggcatgaaatgagctgatgcagggacaaagaggagttctgcagggtattgtaatccatatctgtcagcagacagaactctgtaatatttggagtgataacatctgcacgtgcggtcagttccttcatggcagacaggaattcggaagtatacatatcataggtcatgccgtcatcacccattacaggatcaaccagaagaaaagtatctggtgtctggaacgtatccagaaaatgaaaaatctcttcaatctgaggtacactggcaatgtaaccggtgtagatcccagaaaagcaagtgccgagtttcttccattcctgacggaaataatccatcttatcggtaaaatcatagcagtagtagcttggatattctgtttgagaacttaagatggctgtcgggagtggacatgtctggatgcccatcgcagataatacagagatggcggcagtcagggagcatcgtccaagaccggacagatcattgattacagcaactttttttgtcattgtcataaagaaatcctcgtttcctaatatatttacaaacatgtattgattatattatagttgggtttttttgccttaacaaaagaagaaagaaatcttccgggtaaaaaataataaaaaagtttgaaaaagttgttgacagatggaatacattgcgctatacttaatttcgttgctgaggtacaaaagcttcggaaacaataaaatgaatatgtgcgcgtagctcagctggatagagcgtctggctacggaccagaaggtcgggagttcgaatcttctcgcgcacgtaggagaaacccttgtttgatataaagtcagacgagggttttttgctgttacatgtccggcgagtcatattttttatacacggtttcgtacacggtagaccgggcagtattgacacagattgggcaattgtggtaaggttacaaggtaaattaaatcatgattgtgtgaggtgtcagtcaggatatcaaggataatttatgggaattattttatagaaagaatgatctgactggtgaaaagggaaacaggtgagaatcctgtacgaactcgtcaccgtattttgcgagcggaagctgcatacccactgggatgactgggaagggagctgaagcgccagagcaataagccgggagacctgcctttcgcagtacaggaacgtaaaagttcaggccacgaggaattggcagtacgaaataagtcacagaactgtatgtgatatgtagatattatgtaatacagttttattttcgttgtcttcgtttcctggcggaggctttttttgatattatgtgtccggaaggaaccgccggtggcagagatcttgtatctcatgtattgacaatcaaaaaacaggaggtagaaagaaatgaaaaagaaactggtagtagtattattatcagcagctatgtgtgtagcggcatttggcggatgtggagcaaaatcagacagctccgacagcagcagtaacaagaagacagagacttcttcaaaaaaggaagatcagaaagcagcggatgcagttgcaaaaaagattgatgcgatctacgttcaggaaagaacagacaagacggatgaacagtgtaaagcagcaaaagaagcgtgggataaattgacagatgcgcagaaagaactggtagaaggagacaatgcagatccggattacttcggaagagatacaggagatgcttcccaggatgacccgttaaatggagatgatatcggagagaaggaacttctggtagtaagtttcggtacttcttttaatgcgagccgtgcagccgatattggtggagtagagaaagcactccaggcagcaaatccggactggtctgtaagaagagcatttacagctcagatcatcatcaaccatgtacaggcaagagatggcgagaagattgataatgtggatcaggctttagagcgtgccgtaaaaaatggtgtcaagcaactgattatacagccaacacacttaatgcatggtgcagaatataaagagttaacagaagcagtggagagttacaaagataaatttgaatctgtcaagatcgcagaaccgcttctcggagaagtcggatcggatgcgacagtgatcaatgcagataaagcagcagtagcagaagcaattacagcagaagctgttaagacagcagaatatgacagccttgatgcagttgcagcagacagtacagcatttgtattcatgggacacggaacatcagatgaagcaaagatcagctattcccagatgcagacacagatggaaaagctgggatataagaatgtatttatcggaacagtagaaggagaaccggaggaaacttcgtgtgaatctgttatcgcaaaagtaaaagatgccggatataagaatgtcattcttcgtccactgatggttgtggcaggtgatcatgcgaacaatgacatggccggagatgatgatgattcatggctgagccagttcgaggcatctaagaactttgacagtgtgaagacacagatcgcaggtcttggagaaatcgatgcaatccagcagttatatgcagctcatacaaaagcagccatggatgcacagtaaaaaaatattaaagggagagaacaatgttaagaaaaagactgatgacgcttgcattagcggtagtgatgaccgtgtctgtatttacaggatgcggcagtaaagatgacagtaagacatctaggtcagagagcaaaaagacagaacagcagaagtctgatgcgaaaaaagagaaagcagcagaaaaggaagagacaaaagctccgattgaagatggaacctatacagcagagtttaaaacggacagttccatgtttcatgtaaatgatgcgtatgatgataaggggacattgacggtaaaagacggaaagatgacgattcatatcagtcttgtatcaaaaaatattgtaaatctgtttcctggtacaataaaagatgccaagaaaaagggagcaaaacttctgcagccgacgacagatactataacagatgaaaatggtaatgtcgtaacagatatagagggtaagccgaaagaagtatacggttttgatgttccggtgccggcactggacaaagaatttgatctggcactgatcggaacaaaaggaaagtggtataatcataaagtaagtgtttccaatcctgtaaaagctgaataaatatcaattgatcataaaatctcttgtctttcatattattatacaaagtgtatatgtgaaggataagagatttttttattcatttgtaatggtgaaaatgcataaaaaatacaatatttactagacttttatgttaaaatatactaatattaaatcaacagcaaaatgtaataaaaacaggaaggaagcaagcgaatgaaaggaaatgtaatagtaggacaatctgggggaccaactgcagcgatcaatgcgagtcttgccggtgtataccggacagcaaaagaccgtggagcgaataaagtgtacggaatgcttcatggaattcagggattattaaaggaaaaatatattgatctgtcagatcacatcaagacagagctggatgcagagttattaaagagaacaccggctgcattcttaggttcctgccggtataaacttccggagatacatgagaaccgggaagtttatgataagatttttgaaattctggataaactggatattgaagcatttatttatatcggcggaaatgattctatggacacgattaaaaagttatcggattatgcaattgtgtttggacattccatccggtttataggatgtccgaagacaattgataatgatcttgcgttgacagatcatacaccgggatacggaagtgcggcaaaatatatcggaacatcgatgaaagagattatccgtgacagcttctgcctggaatatgaaaagggcgtagtatctattgtagaaatcatgggaagaaatgcaggatggctgacaggttccacagcactgtcacagggagaggattgtgaaggtccggatcttatttatctgccggagctgccgtttgatcttcagttattcggggaaaagatcaggcagttattacaggaaaagacatccatcgtagttgcggtatcagaagggatccgtacagcagatggtacatatgtatgtgaacttggcaacagtattgattttgtggatgcattcggacacaaacagttatcaggaactgcatcttatctggcgagttatattgcaggtgagatcggatgtaagacacgtgcgattgaattaagtacattgcagagagctgcatcgcatgcggcttcaagagtagatattctggaggcatatcaggttggaggagcggcagtaaaagcagcagacgaaggagataccggaaagatggttgtcttaaaacgtctgtccgatgatccgtatcagtgcggaacggaagtgaaagatgtacataagattgccaatgatgagaagctggttccaagaagctgggtaaacaaagaaggcacttatgtaacaaatgagtttatttcatatgtacgtccgttgatccagggagatgtatcaccggttatggtagatggaattccaagacatctgtatacaccgaaagaactcagccacagataatccatttaaaatcagagagaagataaaagaacggcctgtcatgaggatatctcatgtcaggacgtttttttatcgggacgtctgatcttctgcgataaaaaagtgcatgaaaagtaaaaaaaagtcttgaaattttgaaaataatcaggtagtatatgcttaatctatattttcaagatagattcggttaatcaatctataaagattctataacctgtgtgagggttcaaaaaattaccatttgtaaaaaaactgaagaatagaattgaggtggaatgcattgcagcaaaaggaaagctatgatgtactgcgtctgatcgaacatggacagatctgttatatcagttctgaaaatgtacagggaagaacacttgccagatatttgaagtatcatccggtaatggagaagaaggaaatgttcctgttgttaaaggcaattgcagaacagctggaactgatccacagatgcagagggaatccatgctatcagtatgtgaatccatacagtattattctggcggaggacggcagggcttattttctggatatgaaagccgagacaaacatgaaacaggtagtatttatgcaaaggagggacatgcgggaatattttctccctccggaagagaattattatcaaaatgccagtaaagagctggacatatatggattgggaaagacatttcaatatattctcgcttcgtcagaaacagaaccgcatctgaaccggtgggaagaacacagacttcagagtatcatttcaaaaacaatgggaacaaaagggtcttattatcaaagcgtttcagaaattcaaaaacaaatcccaaaatggaaagaaaaagttaataaagaaagttcgggagacaaaggaaaacgcaggtggaagatatatatcgcattatttttcgcagtggtggcggcagggtacatgttgatacagcaaagaaaaaatgtacctgacggaataataaaggaacaacagaaagcaaccagtaatgccaatacagaattacgcacagacagtcaggagaatgagaaacgggacgaagaatatctggaactggcacttgcgtatttcttaaatgtcgggaatgtggagaaaagccgtatttgtctgaatgaactgaccaataaagaacttgcggagaatctgaaaatgttgatcggcgcatatgaaaaacaggaatgtccggaagatgtaagaaaatataaaaagagtcttgcatatctggaaaaggtatggaaaaaaaggagcaagatatccgaggagaagcaaaaacaggaaatccagtgcctgatcagaggatatggacttctggatgacgaggacagtgtagaaaaggtattagaactggtaaagagggggatgcagacggattatctgaatgatccggtaaaaaaagaaatgttagaataccaggcggccgcctgtgaaaaaaagaagacggaggaggaagcggcaaagatatatacagagctattggagatggagcaggaggacggaaacagagaaatgttgtataaaaaaattgcacaattatatgaagcagcaggcaggtgcgatatggcaatggatatctgtattcagggaatcggagaattgaaggaatctcaggagttaaaactgatgcatatccgattcatgtgtgcagatccgtccgtcagcagggaagaatgttccatgaagatcaaagagtatgtaagagatgacggacaactgccggatcaggaggaatttaaaaagctgcagaaagaatatgcaatcaagatggaaggagaagaggtatgggtaggaagataaaaaaagcaatcacggttgtaatagcaggaatggtcataggctcacaatttgcagatatgtcagcagttggaagcattgtacaggcagaggcaggagatcacagagaagcagaaaaagaaacagatccggaagaagacaaagatgagaataaaaatccggaagaagacaaggacccggaagaagacaaggatgagaataaggatccggataaagactctgaaaaagaggataaagatccggaagaagactctgaaaaagaagcgataaaaccttatcagattatatataacgaaccagatggggaaaacggatactatattcatcgtccggatggaagaattacgcatatgagcaaaagagggacaacaagatatctcttcaaaaatggaaataatgaacaacaggaaggaatattggacagacaaaatgaaagcttcctgttgaaacaattgaattttacagacggcggaaatgaattgaagatatggatggaagatgaaaaaggacaccgggtagaaaattcagaaagtcaaaaagaattctggctggatagcagtaaacctgtagtacattatgaaataacaggaggttcggagatatggcacaaagatattgcggaagtccgggtagaatcttccgatgggctaaatggaagtcagattgcggaaattatctgtaaaacaggagaaaaagtaattggaaaaagcaataaagaaacagaaatatttcgaatggaagaagaatcgaagaatggtgaaggaattcctgtaacttttattgtaaaagatgttgcaggaaataagacgatagtgacagataaggtctatattgacaggaatgttccggaggcagctatacaaggagtgcaggattatatgatcaccagtaaaccggttaaagtgaactatctggcagaagaggaaaatatatttcaggttgtgcaggcacatatttcgaaggaagatatcaccggaagaaaagaagaaacagagatcacagagtggcggataggaaagtcggatgagtcaggaaagatgagaaaagaaagcagtcagacgcttacagaagacggaatatataaactgagaatgagtgtagctgatatggcaggacatgaaaatcaggtggagcgacaggtgattattgacaaagaaaatccggtgattgttcatgtggatgaactggatggaaaatatttaaaatacttccgatgggattattcggccggagaatcggtcaaagattttaccagttatacgtacaccatgaaattagatgatacagtataccgtccgggagagaaaatcgagaaagaaggcatgcatacactggttgtggaagcggtagattctgcaggcaataagagtgatgcaaaggcaaggtttacaattgatcataccccgccggtaatcagatttgaaaatatcagagaaggagaaagctatgaaaaggaaagaaaattttatatccgaacggaaaatccggaagatcagattgaatacattaagattaatggagcgaagcaaaagagtgaaaagcaaaagggactttatgaatgtaaagtagatgaagcaaaagcatatgaagttgaagtaaaggcaaaagattttgcgggcaatgaacagatctcacggattggatttcagatagagcaggaaaaaacattattacagaagataacagagcctgtaaagaaatatattttttatggaaatgagaaagcggtaaaaaaagaagagcagttaaaagaagaacagatgaacaaaagaaatggtaaaagtatattgtgttcaggtattatgctcacaggtatgttaacgggaattggcttctggaaaagagaaagattggggaatatattgaaaaaaatgcagccagacaacaaaaacaagtagaatttttccataaaagggaggatgccgggtaaccgctttcgcgattcccggcatgtattatgaaaaagtttattccaaatagtatttacatactagataatgtcttgtgtatttctttgatgattatagtataaaaaagacctatgaagaaagaatgttaaagtagtgaaagaattttgaaggataaatgaacaaattgtgaacacgggattttacaaagattttgttggaaaacagaggaaaatagattatactaatagaagtcaattttgaagaaagaggagaaaagaagaatgaaatatatttcttttgccattccgtgttacaattcacaggactatatggctcatgcgatagaaagtattcttccgggtggagaagacgttgaaattattatcgtaaatgacggatcaaaagacagaacatcagagattgctcacgaatatatggaaaaatatcctacaatcgttaaagtagtagacaaggaaaatggtggacatggagatgctgtaaactccggactgacacatgccaccggcaaatattttaaggttgtagacagtgatgactgggtggatgaagatgcacttcataaaattctggaagtattgcgtcatatggaagaagatgccatggaattagatatgctgattgccaactacgtatatgagaaagttggagcagcacacaagaaagtaatccattaccgtaatgtattgccgcaggatgagattttccgttgggatgatatgggacattttcatctggatcagtatattctgatgcattcagttatctatcgcaccgatatgttgaaattaatccagcttcatctgccgaagcatacattctatgtggacaatatttatgtatattatccacttccacatgtgcgaaagatttactatatggatgtagatttttacagatattttatcggacgcgaggatcagtcggttaatgagaaagtaatgatcaaaaggctggatcagcagatatttgtcacaaagacaatgattgatatgtatcagctgaaaaacatcggaagtaagaaattaagacagtatatgctgaattatctggcgatcatgatgacagtttcttctattctttgtatccgttccaagaataaagaaaatctggagaagaaaaaggaattatggcagtatctgaagaagaaagatctgcgcagttttataaagatccgctatggaattctcggacagactatgaatattccgggaaaatccggacgtaagatatcatcgctggcgtatacagttgcaagacgtttgatcgggtttaattaattttctatttaatgcattatagcggctatcaccgatcggaataaaattacaaggtcctatcctgtgctgactccaacatggggaaattctaaagcaaaaaagttgacctaaaaacaaactcacaaaaaatccaaactcgacattcgtctcagacagtggattttttgtgagcaaacggtcaacttttttacttaagaattgccaaccatgagtccgtatgcacaggatagaaccttttattacggttcggggatttggcttagtgaattaaatagaaatctcccctaaaataattctcaatagtactttatccaacataatcgtccggttccaggggttgatgatgatgccctgaatgttatcagttgtaatagcagaattaaataactgtttcatatcggtaagaaatgtagacattacgcttccggaacctttgagttcttcatcgaagctggtaaatgccgcccaccatttgcggccatcatcggtctggattgcctgtatctggaggccggaggcagcggaagaggaatctactgcaatgatcagttcgccatgttcattcatgcgtctgcggatgacggtcaggacgtgagcaagcatttcctgagatggttcctgttgaagagctgcaatggcagattcaatcttgttattgccctgtaaagttttatcggtatgtgtatggtcattcataattgtgcaaaatcctttctagatagataatggatacagagaacctgtcaatgacagcctcgcttgcatatttttgtataaaaatatacggacagcaggagagccatccgtatattaatataaagtatttcagttggaagagcaagctaattgaactcccatggagaaatatatttatttggagatgaagcatatccattgttatatttcactgtgacatataaagagtcatcaccatcaaccagtttcacatagcagatattatctttgttgaatttgtgtgtgatatcgatggactgatttttgtaatacaggatgacggaaccatctttttcgtattctatatccggagcatttagttcttccataatttcttcttgtgtaaggctgcgttcggagccatcctggttaaatgcaatgccgcctccgccaaattctttattttttccatctttatctgcataagttccggtataagaaccgtcagaattgattgttaaagtagcagttgtctgatctccgtggatccagagctggactttacgttgaattccgccaagatcggatgcgtaggctgttccggttccggctgttacgatcaggcatgtggcaactgtggcggcaattgtttttaatttgtgctttctatttaagatactcattttatctacctccagggaaaaattgtcggaggcggaaagtgtatcaaaagcctgcttgtatttttctttattcgtcatcgttccattcctcctttaaggtttctttgagaagagcacgtccgcgggaaagtcgggtctttacattgctgacagaaagatgcaggatatcactgatctcttgtgttgtataatcttcatagtaaaagagatgcaggacaattcggtatttttcaggaagtttcattactgtatcaaacagagtttctgattccggtgtttcgaaggttaatgtttccatatattcttctaagttgcatttatttctgtgccagaatgagcgggtgatattctttgctttattgatcgcaacccggatcagccaggcacggatatgttcttctgtatcaaactcttttttatatgtgtgatactgaataaatgtatcctgaacgacatcttctgcatcttgttggttcctgcatatattaaatgcaatcgcatacagatgcttttgatatcgttcgattaaaacttgtgttgctggtttcatgagtactcctttttggtgttagtgggaaaacagatgttcatttcttaaggcctttcacttataatacaaatgaaaatatggaaaggttacaaatggaggtaagaatatatgttttaactatatcttactatcgagcataagcattttacattttaaaatatacgttgtaaactatattatgaaaaaataacttcgaaataagaggtgaaagataaaatgtatctggtatcggtgtattttgatgataaaagcaataaaataatttccgattatattaataagattgcacaaaagacaggaaatacttttatgacggacaatcatgttcctcctcatctgacgataatgtcagtggaggcaagggaggaagataaattgacagaggtgatgggaaagttggagagatatctgacaaaaggacagatccagctggtctctgtcggagtgttattgccatatgtactgtatgtgacaccggttctgaatctgtatctggaagatatgatcgaacaggtacatgatatggtaaagaatattccggaagtcaggatgagccggtattatcagccaatgcagtggcttcctcatatcacactgggaaagaagctttccaaagagcagatgcaggaagcatttgcagttatgcaggaacaattcgtaccgatggaagttacggtatcggagatcgggctggcgaagaccaatccacatcaggatcttataagagtaaaattaaatgattaattgaggtggaaaataaaatgattaatagagaagacatgctggcactgaccagaagaatgacagtaaagagaacatccatgacaagaattgccggaggatatctggaccgggatggatatatagacggaacatttaataccggatttttgaaattgagtccggacgagaaagaaaaaaatttacagatagcaaaatccattccattttcagatacgaataaaaatctgaaagaatatgcattttccgatgagaagatgaaaggcgacagtatgtggaaactgttaatgggaatgcgtgcgtgcggtctgaaaaatgatgcactgatggagactttttatgaaattgttggtgaacgatatcagtcagagggagactatgccattttcgtatttcatgaccgatacgatattccggcaaaagggaaagatcatgtccgtcagggtgaatctgaagaaatgtttgaatacttaatctgtgccatctgtccggtaagtggagattacgaaccgggagaaccggaatgtggattcttatttccggcatatatggacggcggggcggccatgaattatgtggatgtatatcagaagaatcaggaatatccgcatacagagcttttgaaattacttggagtatgatgagatagagaaaatttcttataaaggtgtttaatggtttcaaattcatctgggatatcttataatataaaggattgagtttagaggaaaaggtaggaatatacaatgcatacaatgaaaaaattcattcggtattatgccccgtataaggcggtattctttttggatctgatctgtgcggcagtcataagtctggtggatctcgcatttccacagattttacgtacgcttacgaagacgttgtttacagaatcagcggatcacatactgcatgctttgctcccgattggggcaggattgcttgcaatttatatattacaggcgctttgtaaatattatgtcagctatcaggggcatatgatgggagccaatatggaacgggatatgaggcagcagctttttgatcattatgaaaaactgtcattctcatattatgaccagaataattcggggcagatgatgagtaagctggtatcggatcttttcgatatctcggagtttgcacatcatggaccggagaacttatttatttcgctgatcaaaattatcggttcgttcatattcctgtttctaatcaactggagactggcaataccgcttctggttctggtagtgttcatggtgttcttttcgtacgggcagaataagaagatgcaggcgacattcatggacaaccggcgtaagatcggggatgttaattcgagtcttcaggatacactggccgggatccgtgttgtacagtcctttgcaaatgaagagattgaacgggagaagttccgaaaaagcaaccagggatttctgcgttccaaggatgccaattataaatgtatgggaagctttatgagcggcaacctgttctttcaggggatgatgtatctggtaacgctggtattcggaggatggctgatcgcacatgggaagatggaggcagcggatcttgcgatgtacgcactctatattgggatctttatcagcccgatacagattctggtcgagcttactgagatgatgcagaaaggactgtccggattccgcagatttctggatgtggtagagaccgagccggagatcgtgaatgcaccggacgcagaatcaatagatgaagtaaacggacacgtttcttatgaaaatgtatcgtttcattatagcgacgatgatacaccggtgctttctaatgttacattcgacattccggcaggaaaatccgtggctttagtcggaccttcgggaagtggtaagacgacgatctgctctctgcttccgagattctatgatgtaacaggcggacgtgttacgatcgacggaaaagatgtccgggatctgacactggaaagtctgcgtaatcagatcggactggtacagcaggatgtgtatctgttctgtggaagtattaaagagaatatcgcatatgggaagccgggagcatctatggaagagattgaagacgcagcaaggaaagcgaacattcatgattttattatggaactgccggacggatatgatacatttgttggtgaacgtggaacaagactttccggcggacagaaacagagaatctcgattgcaagagtatttcttaagaatccgtcaatcctgattctggatgaggcgacaagtgcactggataatgagagcgaacgctggatccagaagagtctggaagagcttgcaaagaaccggacaacgattacgatcgcgcatcgattatcaacaatccgcaatgcggatgagattcttgtagtggcagataatggaatcgcagagcgtggaacacatgaagaactgttaaaacagggcggaatctatgcgcattataatgagatgggataggcagaagataagaaaaacggaagctgttctgtgagtagaaacataaaaattatcaataaagaaatttgcaaaagaaaaagattgtcgtgaaaagaatatatgatataatttacaaagatatcagcggcagaaaagacagtgcaaaactgtaaaggaacagtagaaatgattgatatcagtgaataaaaacggccacagaataaggcggcaaatcataagaaacagaggtagaattatgggaaaaatcagaattggtatcgttggatacggtaacatcggacgcggagtagagcagtctatcaagcgtaatgatgatatggaattaaaagcagtatttacaagaagagatcctgcaagtgtaaagatccaaacagaaggggcagaagtaaagcactttgatgatatggaagctatgaaagatgatatcgatgtaatgatcctctgcggcggatcagcaacagaccttccggtaatcggaccgaaggtagcagcatcattcaataccattgacagctttgatacacatgctaagatccctgagtattttgcaaatgtagataaagcagcaaaagaaggaaagaatgtaagtattatctcagtaggctgggatccgggaatgttctctctgaatcgactgtatgcagagtctatcttggtacagggaagcacttatacattctggggaaaaggggtcagccagggacactctgatgcaatccgccgtatcgaaggtgtgaagaacggaatccagtatacggtaccgatcgaagcagcggttgaccaggtaagaagcggaagcgaaccggagttgacaacaagacagaaacatttaagagagtgttatgtagtagcagaagaaggagcagataaagcagccattgaagaggcaatcaagacaatgccgaactactttgatgaatatgatacaacggtaacatttatcacagaagaagaattaaaagaaaaccacagcaagatgcctcacggtggattcgtgatccgtaccggtgagacaggatgcgaaggcaacaagcatgtgatcgaatattctctgaaactggattccaacccggaattcacaggaagtgttctggtagcttatgcacgtgcggcacacagactttctaagaaaggtgaatcaggagcaagaagcgtattcgatatcgcaccggctatgctgtctcagatgacaccggaagagttaagagcacatatgttgtaagagataattaataaaaatgtatacaagttctatcgtagactattaatgttgtgatggaatataaggagcagaagtaaaaaaatcaggcatcggaggcgaaatgaaaactcgtttccggtgcctgattttgtagaaattacggatgatgattttgcgggtctttgacaatatttccataagaaaatgtaatgtgaaattcctcgtaaagttttgataaggcggagagtgcttttagtaaaagaaagaagctatctaaaatgagagcttttacgtacaatatcgaaacgtacgatcggtcagaattctcgcaaatatcagtccaagcggcaacatcacaataatcataatcgcagaagtaaaccatgaaaccgcatccgtcagggacataatcccgaaattataaatcgcacggtacaggtaaagtcccggaaccatgatcacgatagaaggcacggtaagcgagattcttggatatccattactctttttaataaaagaagcaagcaatccggcagtcagagccccgataaatgcggcggcggccggaggcatatgtgtgaaatcaacaagttcaagccggagtgtattggcaatggcaccaataaatgcagccgttgccgccatcgaatgagaactgttgaacatgatcgagaaaccgaatactccgcaaaagcttgcaatcacacggaaaatcagatgggcagcagcacttagatgcagcgccgtaaaatcagccggttccagatgcagaagtaaagccatgatccatgcaaataaagtggcaaccataacgataatgattgcataagtaagccgctccagtcccgaacgcagatccagctttgcaaggtcgatcccgcttgtaataaatggaaatcccgggatgatgaacagcatcgagcagatataaccagcttcatgaaattccggaatgtgaaagacaagttccgcaagtttcagaaagactgcataggtaaaacatgctgctgaaacagagactgctatattcaaaaacagtgtgtaatggtgtttgatcagtttcgtacggatcagattaccaatcccggcggcaataaaagcaagagccatctcaaccggtccgcctccgagtaaaaaagtaaaaccgcagcaggcaagagctgcggcaagccccagctttgcaggtgaataaagagcatggatttcttcaatttcatccagtcgtttatggatatcttcaccggtcatatgcgcttcttcttccggaaaatgatctacaaactgttccatgcggtaaagcttggaggtattcactcccgtattggcaatactcaatgactgggaaatacaatcgtttccatcgaaacagttaaatacaatggacatcaatcccacgtctaccgtacaggttacaccaagctctttggaaagccggttcatggaagtccgtacacgccatgcaccggttccacacgagagcatgattaacccaacacggccgatgacagaagctttctcgatcagtccggcttctgcaatcaacacattactgtcatcattggcgtagtcatgccatggaatctccatatgatttttttccataatatcaataaagtcagaattagttgtccgcataaatgatcgcctctgctttggaaacgtggcgttccagattttttaagaaatgtgaattcggaaggaaaactccgatctcatcataacgggtattatcttcaacaagagaatcctgtccatagaatacataggacataggaagctctttctgaagttttatgacaatatccagaatagcagaataagcttctgcttcggtttcttttaattttacggtatccggtaattcacggattaacagtacaccgttattcttttccagaatgttttgttccggttccatatcgtcggatgtataagaatggctgtagcggtatgcttgtgccagaaaaatattctttggagctccgagatctgtatatacctcatggaaatgacggtattcccgttcatgaatcgatctcttatattcaggaagtaacattccgttttcatctgtcatgatcatcggattctgttttccgtccgcattgaaccgatagggaatcaggaatgcatttcttaaaagatcaaagactgtattctgacagatagccatcagaaacgcagataaatcccgattgcgataagaattaaaaagagcctgtgcgaattctgtagatgacggagaatcgggaaggtctaccccatcgttactgaataaataactgcagaatgtttccatcagtttttcacatgcccatttatcttcggatatttttttgaataatatttctgatttttcttctctgggaaaaagtgttttttccttcatagtaaagcgcttcctttcatattttcgtctgaataaattatacaactgtgataaaaataagtgaaaactataattgatataatagatatatgattatggtatgccggagaagtaaaaatcgttctatcatctggaagtaggatatactgataacagctgattaacagaaatatggtacggaatattacttttgataataaatagaatgaataaaaatagttgtttcgaaaaaagtcagaaatcagaaaaaatgagttgacatttcgtgcaggtgtttctatacttaaacatgtagataaaacacggggagcttgtgtacaggctgagaggaagttaagaacttcgacccatatacctgatttggataatgccaacgtaggaatgtataacgtagattttaggagagatgcatttagttggtatctctcttttttgttgctatgtgacgtaaatcaggaacaatagaatatcggataagttgagagtgaacgagagttcacgaaggggtgcaccaccacgggtgtatttacttcgtgaactcttttttatctgacaagtacttttgaaagtatgatccgggaaaggagaacgcatgattatcgtaaatggaaaagaaattaatttgacagaggatacgacggttgcagaatatctggaacagaatcagtatcaggtaaaaagaatcgctgtagagttaaatggagatattcttccgaaatacagctattccgataccatgttaaaagacggcgaccgtctggaagttgtgacattcgtgggaggaggctaacattcatggaagaaaccggattagaaaatatgacggagaatacagaaaaagaaaaagtacttagtaaagaagcgattgtggcagcattaaatgagagacattctccggagaaacagaaacttctgtcagcggggagggttgcgatcgccgggcttggcggattggggtcaaacgtggcatatgcacttgcaagaatcggagtcggccatctgcatttgattgattttgatgtggtggatatcacgaatctgaaccggcagcagtattttatggagcatatcgggatgtataagacagatgcgctgaaatcattattgttaaagatcaatccatatctggatatcgatacagattgcgtaaaagtcacagaagaaaatcttacgaaattattttgtgacgaaccgattgtgtgtgaagcattcgataatccagaagcgaaagcaatgctggtaaatggaatactggaacattttccggaaaagaaactggtatcggcaaccggtatggcaggatacggaagcagtaatacgattcgcacacagaagttaatgaagaacttttacctgtgcggagaccgcgagacggcaccaacgtatggaaatggcctgatggcaccgagagtggccatctgtgcagcgcatgaagcaaatatgatcacacgtctgattcttggggaagaagatgtgtaaaaaacatatagaaaagacaaataataagaaagaaggattggattatggacaacacagaaataaagaaagcggatacatttacccttggaggaaaagaatttacgtcccgttttatacttggttcaggaaaattttcactggatttggtgaaagcatgtgtggaaaaagcaggggcacagattatcacactggcactccgtcgtgcaaatgaaggcggtctggcaaatattttggattatattccggaagatgtgacacttcttccgaatacatcaggagccagaaatgcagaagaagcggtacgtattgccagactttccagagaagtcggatgtggcaatttcgtcaaagtggaagtggtaagagattcgaaatatctccttccggataattatgagacgatcaaagctacagaaattcttgcaaaagaaggattcgtggttatgccgtacatgtatccagatctgaatgctgcaagagatcttgcaaatgccggtgcagcatgtatcatgccgcttggcgcaccgatcggatcaaataaagggcttagcacaaaagactttattcagatcctgatcgatgagatcgatctgccaatcatcgtagatgccggaatcggacgtccgtcccaggcatgcgaggcaatggagatgggagcagccgcagttatggcaaatacagcaattgcgactgcgggagatgtaccggcgatggcggaagcatttaagaaagcaatcgaagcaggcagaagtgcgtacctttccggacttggaagaacgattgagcgtggtgcaagtgcatcttcaccgctgaccggatttctgcaggattaggaggcacgacaaatgggaacaaatcatgaagatacacatattaatgaaagtattttaagcgaggagattttggaagaccagaagaagaaccggatcgatcacatgacctatcttccaggcatggaggatatcggatcagaaatactcgaccaggtcgtggcagccatggaggcttatgattataatacatatacagcagaagatgtaaaacgtgcactggcacatgcagagcgcacaccggaagattttcaggcgttattgtcaccggcagcactgccatttctggaggaaatagcgcaggcagcgcagatcgagacgagaaaacattttggtaacagtgtctatatgttcacaccaatctatatcgcaaattattgcgagaactattgcatttactgtggttttaattgccataacaaaatcaaccgtgcacagttaaatgcggaagagatcgaaaaagagatggcggcgatcgctgagacaggtctgcaggaaatcctgattctgacaggagaaagccgtaacaaatctacagtagaatacatcggtgaagcatgtaagatcgccagaaaatattttaaagttattggtctggaggtttatccggtaaattcagacgaatacgcatatctgcatgaatgtggggcagattatgtaacggtattccaggagacatacaattcggataaatatgagacacttcatcttgcgggacataagagaatctatccatatcgtgtcaatgcacaggaaagagcattgaaaggcggcatgcgcggagtcggattcggtgcacttctggggttggatgatttcagaaaagatgcatttgcgaccggatatcatgcttacttattacagagaaaatatccacatgcagagatcgcattttcctgtccgagacttcgtccgatcatcaataatgaccggatcaatccgatggatgtgcatgagccgcagcttctgcaggtagtgtgtgcataccgcctgtttatgccatttgcaagcatcacggtttcgacacgagagtgtgaaagagtccgcgataatctggtaagtattgcagcaacgaagatatctgctggtgtaagtaccggtatcggaagtcatgtagaagatatcgaagacaagggtgacgatcagtttgaaatctcggatggacgttcggtggatgaggtctatcaggcacttctgaaacacaatcttcaaccggtgatgagtgattatatctatgtgtaacagggagcatcttgtgttaaaaacatgccgaatacagctgaaaggagttgtcagtgataaaatctgtaaacaatcaggactttaaaatcattgcagtcagcaatcggaaattatgcaaccgcccgtttttagagcagatagaaagagtctgcaagatacatccggaagctgtgatcttaagagaaaaagatctgacagaagaggaatatgggacattggcaaaagaagtaatgaatatttgcagccgttatcaggtgtcttgtattcttcataatttctggaagactgcactagaactgggatgtacatctgtacatctgccacttccgattttgcaaaaaataactgatgaagaaaagaaaaaatttacaaagattggaatttctatacattctgtagaagaagcgaaagaagcagagcaattgggagcctcctatcttacggcagggcatatctatgcgacagattgtaagaggggattaccgccaagaggattgggattcttaaaagaagtttgccgggaagtcagcattccggtatatggaatcggcggaataaagttcgatgaagaacagtggaatgatatggaaaaatgtggagcaattggtggatgtattatgtccgggatgatggaaatatagtaatcgaaataaaacagctcatttttaaaagagcaggaaagccttctgagtcggtactcggaaggcttttgctttgcactggcatataagtgcatatcagatagtactttacaaaattatttctaagtgttatattaatacaaaaatgaatagttcaaaattgaaataaaaggagagctacatatatgaacacaggaatcgaatttgcagaaaagctgtcaaaggcatacagtgagacctgcaaaccgttatgtcatgaactgaatattccacagaccgcatttgacatcttacttttcctggcgaacaacccagaatacaaaactgccagagacatcgtagaaatacgaaaaattaaagccaatcttgtatcggtaaatgtggataaacttgtgaatgaaggctatctggagcggaaaagtgtagaaggtgaccgaagaaaagtcaatctgatctgtacagaaaagtcaaaagagattatccaagaaggacagaaacttcagcagtcgttcgttgaaaaactatttgaaggaatggatgaagatacaagaaaagctcttcaaaaaggaatggcgcatatggaagcgaatatagagaagatgttggaggaaaagaactagatgaatacaatattaatgattatcgtaacatttttcgcggggatgggagccggactcggaaccggatttgcaggaatgagtgcggcggcagtgatcagtccgatgctgatcacatttcttggaatggatccatatatggcagtcggaattgcactttcatcagatgtacttgcaagcgcagtatctgcctatacatatggaaagaataagaatctggatgtgaagaatggtctgatcatgatggtcagcgtacttgcctttaccgttgtgggaagttatgtgtccagtctggtaccatctacaacgatgggaaatttctcggtatttatgacattcttgctcggcattaagttcatcgtaaaacctgtcatgacaacaaaagaagccatggaaaaagtatcgccgaagaaacgtgcagtgcagtcgttaatctgtggtgtcatgatcggatttatctgtggatttatcggtgccggaggcggtatgatgatgcttttgatcctgacctctgtcctgggctatgagcttaagacggcggtaggaacgagtgtgttcatcatgacatttactgcctttaccggtgcagtttcgcattttgcaatcgggggaatgccgaatatagcggtgtggatcttatgtattgtgttcacactgttgtgggcaaggattgcggcagtatttgcgaataaggcaacaccgaagacattgaaccgggcgacgggtgtgatattagtggttcttgggattgtggttatggcgttttctattttaaattaatagagagcaggaagaaattaatattataggagagaataaaaggtattaatagaaaaataatatgatgttttgtttattatgcattctacagggactgccggtggcaggtcctgtagaaagaaaaacattgcttatgattctttaatatttcccttttctatgttttctttgagtatctggtctgttactttatataaagtctcagatcccagctgcgttttccgttgtcttccgtatacctgttcggaagaaacctgatgctcacgccagtcgccaccgccgttactgttattgagaagcaatggctgcaggttatccagggaatgtgcaaatttggattctggtgtctggtaattttcgaattcatcaaagagtgcagtcagttcttttttctgatcttctggtaacagtgagaagattcgttctttggcagcatcttcacgtgctttctgcgtctttaatctttctgtatcgtaggcataagtatctccggcgtcaatttccacaatgtcatggatcaggcacatgatcataacttttgcgatatcgacgggttcattggcataatcttttaacaggtatgccataattgccatatgccaggcatgttccgcatcgttttcacgtcttccgtgtccggaaaggtgggtttgtcttaatatattcttttctttatcaatttcgagaatgaaatcaagttgttgttttaatctttcgtccatgataattcctccttgtgcgttcagtacgaacaaactataagatagtataacataaaagaaagcataatgaaaagcaaaaacacagtaaacatataaaacatattgacttaataggaaaatggtgttaaactccagttattaaaagataaaagagagaaaagctcagaaggcaggtgcaggaagtaatgaaacagatattatgctttggggattcgaatacatgggggttagacggagagactggaaagcgcttttcatgggaagaacgatggaccggaatcttacaggaaaaactggcggaccgagatattagaattgttgaggagggtctgtgtggaagaacgaccatatttgaagatccgcttcgcctgggaagacgaggaacagaattgcttccgacattattggagacgcacacgccggatgcagtcgtgttgatgcttggaacgaatgactgcaaaatcatattcggagcatcagcagaaatcatcggaaaaggaattgccaggttactggagcagatcaatcagtatgcagataagatgaaggttcttgtgatatctccgatctatctgggagaaaaggtatggcaggacggatatgatcaggaattttcgccagaatccgtagaagtatcaaagaaattagaaccggtatatgaaaaagtggccggaaagtatggcaaacgattcatgcgggcagcagattatgcgggtccgtcggaagcagatcaggagcatatggatagacagagtcataagattcttgcagatgcgatttatagaaaattagaagcagagattttatagaaaagataaaaatccgttgtcagtcaatggtatgtcctgttttactggagttccggtaaagggaacatatcaggataagacaacggattttctgctatcttttggatgtaacttctgcaacggattttccggtgattaattccattaccgtacttttggcatcgatagcggtaaacactcctgcaagaatgaaaatggccccgagatatcccatctccgtgagcttctcatgcaggaagatgaaggaaaaaatcgctgcaaagatcggttccagggagaacaggaatccggtattctccggtgttgtatattgctgcacaacagtttgtacaacgaatccgtaagctgaggacaggagagcaagtccgagaacggagatccagtccaacgcggtgctcggaaatatcggggatccgaacaccagcagaccgattatggaataaagacaggtaaagccctgctggtagactccgagtgcaagtggatctacctgtctggtaaaatagctgtttaatacaatattgattgaataactgaaagccgaaagcatacaaagcaacgttccgggcttgacagcaaatatatcaccgccgttgatcagtaccattccgatcaatacgataatgattccaagcctgacatgatgctccggaagtctccgggaaataactgcatgaatgaccggaacaagcacaacggtggtgctgaggatgaatccactctgagaagcagtgattgtatttaatccgtaaaggattggcgtaaggtttgtaaaaagcagaaagccggtgatggcactgtagagtaaaagtcttttattaactttcagtaaccttttgaaaaatataagtaccagaatcagaaatgcgattcctgtacgcagagccatcagcatcagaggggaaagtccctcaattccaagtttcataaatatataagaagttccccatgccatagagcaggttgtaagaatcagattggctttttttgtcgacataatcggcgattcctcctatgtaatagttttcttgttttttattatatagtagaatagaatataagtaaaattcatatttatcatgatgagaataagaaaacaaaatattttgaaaaataatcaaaaaagacataaggagaatgtagaatcatgagatattcaaaatatacaattttcttaaaagtagtggaattagagagcttttcaaaaacagcagatttttataaatactctcagtcagcagtcacacagattgtgaagtctctggaaacggaacttcagatgacattattaaaacgaagtcacgcaggagtgtgtctgacttcagacggagaacagctcatcccctatatatgggaactggcaatggcagaagaaagaatgtgggaaaaagccggagaaatcacaggaatggaccggggactgatccggatcggggtattcagcagtattgcgtgtcactatctgccgggggtgatgaaagaattccgaaaattatatccgggaattgattttgaactgcatacgggagattattccaaaatcgagcagtggattgctgaggggctggtagatttcggattcctgatccggccggtgcggacggactatgataccattgacattatgacggatgaaatgctggccgttcttccagaaaagcatccaatgacagaaaaaacagagattccattaaaagcatttgaggatgagtcagttgtactgcttcaggaaggcggcaagcaggaaatcgaagaacatttcaaaaagaataagatcgcaccgcacatttcttattattccggggacgattatgcagtgatgtctatggtggaaaacgagctgggaatcgggatactgtcggaactggtgatgaaaagatgcgattatcatatcgtaacaagaagtctgaaaccggagctgcaccgggagattgtgatcgcggtaaagaatgagaagaatgcttcggtagcggtgaagaaattcctgcagtttgtaagaaaaagggaaaatccttgattcgtgtatttttaagtaataaaatatggagaagtggatagtgtatatctataaataacaacatttcagaaagggagccttagaaattgctggaaaaattaagagaacttggaatcagagatgagctgatccgtgagataacagaatatagggaaacatacccggtagaacaagaatatggttcaagaattccgaaactggaacaattttactatggaaaagaagtctgggagcaggcaattaccgcaattttgtgtggagagaatattctgttggcaggtccgaaagcaacgggaaagagtctgtttgcagagaatctggcgggagtatttgcaagaccacggtgggatgtgtcgtttcatgtgaatatggatgcagcttcattgattggtatggatacattccgtgggggagaggtatctttcagaccggggccggtgtatacagcggcaaaagccggtggatttgccatattagatgagatcaacatggcaaaaagtgaagcaatggcagtacttcatgcgacactggacttccggcggacgattgatgttccaggatacgaacgtatggaattacatccggcgacaagattcattgcaacgatgaactacggatatgcgggtacaaaagaactgaatgaagcactggtatccagatttgtcgtaatccagatgccgatgatttcaaaggaaagtctgattaaattaataagaaagcattatccggacatcagggaagaaggagcaggagaactgacatttatgtttctggaattacataagaaatgtgaaaatggagagatatcttccaaggctctggatctgcgtggtctcttaggagcagtcggtctgatggaaaaaggacttgatatatttacggcactggatatgggaattaccaataaaacatttgatacctatgaacagaccctgattcgtgatacgatccgtacaagaatctcgaagaaaatggtgaagaaagatttgtttgtgaagtagcaggaaagtagtgtgttatagcatggcggaaatagaagaacaagaattaagagaagcaaaaagagcacgcaattttatatgggcggcggcagaaaattatgaacttgaaccacttttccttgcatttgcatcgaacggaacggcagatatgtatctgaatctgattatcggtctgacttacaaatggtacgatcaggagaaaatagatgatttttttaatcagctgggaggaaaagaccgggaactgtatgaaggtcttctttggatcggacttgagaatgcattgtaccaaaaagaaagaaaaataagattagtaatggaagaactgcgaagggagtatgcgctggataatctgaaccgttacaggaattataaagaatatgcaaggatagaacaaatccggaatgcacattgcagagaaattttgggacagccatccgaactaactacagaagaggaagaacttctgcatgcattttcctatacggaagagatgacaacggatgagattctggaacagacacgagagaatctgtggaaatatttttcttatcgtccgtcaaaagctgcgaaaagaaaaggtgtttactttcttcagaaagttgccggagcattccattctgttggaaaagtgagtgccacatatgtacgggcgaagcattatgaagataaagacgctggcagtgaggaaaaaacaggagttatagagcgttcaaagcattatctggtgcagttctcattaaaaaatgatccgggggaggcaagaatatatgtagaagcctgctttggcaagaatatgtacccgcagactgagcaggaaagaatagagcgggagatatgtgtggataaacataagaattgtcatgtactctttacaagaggaagatcaggatggaaagaaaagcagaagagcgaaacaaaattaaaagaactttcggaaatagaaagaaaacgagaacgacaggaaatccttgaatttcaaaaagaatctgcccagcaatatgagagaaataaacagtattatgagaagaatcgtgcaatatacagaaacagtataagaaaacttacagagaaattacgcatctgtctggagacacaggacgagacatttccagaaatggcaacgcacgggaagatcaatccgagagaagtatggaaagcagtttatctggataatccaagagtattcgaacggaaagaagaagtggagattccgggattttcagtcgatatgctgatcgatgcatcgtcttccagaaagcagatgcaggaacagattgcggcgcaggcatatgtcctggcagaaagtctggaagagtgtggaataccggcacagatatattcctattgcagtatccggggctttacggtgatgcggatctttaaagattatgaagaagaaaaggttggaaatgaattattcggatatgttgcggcaggaaataaccgggacggactggctctgcgtgcagcaggatatttgatggaagtaagtaagaaagcaaaaagaattttacttgtactgacggatgcaaaccctatggacgaccagaatatcggtgagggagctttttatacgaacaaggaatatactgaccagccggcaatagaggacacagcaagggaagttcagaggttaaagcaaaaaggaatccaggtcataggaatcttcatgggaagtgcaaaatccagagaggcagcaagagagatattcgaccgagaactggtacagattcagaatattaatgattttgccggggcagtggggcgagtgctgggagaagtgatgacgccataggggacgtgaaaaagtggctttttcagtgtcccctatggcttacaaagcacatatattaataacaaaagcatctggagttaatgtatgaccagtcagaaactagaaaatcttttaaatcttgcactgaattccgcggaagatgagcgggaaaaatccttgaatttaaatgttggatatgatccgcttgaccgggaatgggatctgatcatcaaatattccgtaaatctggaccgagtcaggaagatagcatccaaagtaacagaacttcaaaatgaatatgcagtcatccgaattacagaatccagaatcgacatcttatcgggaattccagaagttgaatatgtagaaaaaccaaaacggctgttctttcaggcggcagaaggaaggcgtgtgtcttgtatcaatgcggtacaggatacacgcctttctctgtatggacagggaatattggttgcaatcatagattcgggaatcgattatgcgaatatagattttcgaaatgcggacggaagcacgaggattcggtatctgtgggatcagtctctgaatccggcagatggggaaacagcaccggttggatacagcatcggtgtggagtatacgaaaggacaaatagatgaagcattaaatgcacaaactgtatcagaacagagaaggcttgtgagaagccaggacatttccggacacggtacggcagtggcgggagtagcagcaggaaatggaagaaacagtggaggacgttatgccggagttgccatgcagagtgaattgatcgttgtaaaacttggtaatcccatacaggaaggattcccaagaacgacagagctaatgatggggatcgattatataataagaaaggcactggagcttcggatgcctgtagctgtgaatatcagttttggaaatacatacggcggacatgacgggacgacacttctggagcgctatatcgatgatgtgtcaaatatatggaagagtgtattttgcatcggaaccggaaatgaagcggcaagtgccgggcatacttccggtagaattatttcagaaggagaagagacaatccagcttgcaattcagagcagacagtcatcgatcagtatccagatatggaaagaatatacagatcaaatagagatttcgatcatcaatccatcgggagtgcgggtcggaccggtaccggagatattgggaccacatcgcttccgaattggtcagacagaaatactgctttattatggggaaccaagtccttacagcatttcccaggaaatctatatagatctgcttccggtagaaagttatctgacagaaggaatatggagaattgttctaagtgccgggaagatcgtgacaggacaatatgaaatgtggcttccaagcgacaatgtattgaaccgtggaacaggattcttgtttccaacagatgctacgacgctcacaattccatcttctgccagccgtgcaatatccgtaggagcatatgacgcaaggacatttgcatatgcggatttttcgggaagaggatttaccagacttacaaatatggtgaaaccggatcttgtggcaccgggagtggaagttatgacaacaacagtgggcggaggatatgcggcatttacaggaacatcctttgccacgccatttgtgacaggaagtgcagcgcttttgatggaatgggggattgtgagaggaaacgatccatatctatatggggaaaaggtgaaggcgtatctgagacgtggagcgaaaaaagtaccgggatttgacgagtatccgaatgaggaagtggggtatggggccttatgtacagcacaaagtatcccaaaaatatgaaaacggctgatctgaaaaagtaaatttcagtgcccgagtaataaggataaaaggtacatttttttagtgggataatgtttccaaaagtgctaaaataaaatcatcatacataaagcgaggcgtaaaacaatgaaaaaaatcaagtggggcgttataggaactgccggaattgccagaagttgtaccattccgggaatgatacaggcatacaactgcgaattatatgcaattgccggaagaagcatagacaaagctgaacaatttaaagaaaaattcggatttgaaaaagcctatggaagttataaagaattgttggatgatccggaagtggaagcggtatatattgcgctgccaaacactttacattatgagtgggccgtgaaagctatgaaaagcggcaaacatgtactgtgcgaaaagccgcttgcaccgtgtgaaaagcaggtaaaagaattatttgacacggcaaaagagaatcatgtatatcttatggaagcttttgcgtatcagcacagtccatatatcactgcaattaagaaagagatagaagatggaacgataggagaagtttgttatatagattccgcatttatcacatcggattataataaggaaaatatccggatgagacgggagactcttggagggtgtacatacgatcttggagtatacaacacaagcctgacgttaggacttctgaatgaagaaccagaaaaagtcgaggcttccgcaatcttttcggaagaaaagatcgataagctgacttctgtagtcatggaattcgcagatggaaagaaagcagcatttacctgtggcatgacacttgcaacggatcaggacaggagactggaccgtctggagatagatggaacgaagggaagcattactggaaccaaattttcattcaatggtgatggagaattaagctatatgattcgtacggctgaggggcaggaagaagtaaagacggtagaagttccacagaattatcgcctggaggtagaacaattcggcagatgcatcgatgaaaatgagattccggcggttacggaagaattttcgctgaaaaatgcgagacttgttgagaagattctggaggaaatcggatattaagatgaaaaagaatgaaaaaatcaggacgccgttaggaatcatttctgttttcaagaatgaaatacctgaaagatatcattgtgtagtggaaccggagattttacgtatcagtgagacgcatataaggattctgacaatagatcaggccgtatcctggggagaagaagtgtattcaccaagacttcatcagaactgtatgaatcctgaaaatattacactatatccactggagattgagtggaatggggataaagttacggtttcagatcattatgggatgaaaaagtggataaccggggaaaagttaccggaaattcaagactggaatttaaaactgaaaaaattaagatgtaatccctgcagaaactgtggaagatgttagaaagcgaaagaaaagaggaaaaatatgaattattcagaatgtatagaaaatgcaagaacacgtattggaaattattgtaaggcctgtccggagtgtaatggacgcgcctgcaagaatcagatgcctggacctggggcaaagggaatcggagatacagctatccgtaattatgataaatggaaagaaatccgtgttcagatggacacaattgcagaaaacaaaccggtggatacatccctggagctcttcggaaagaagtttttatatccattttttgcaggaccggttggtgcagtgggattacattacggcgactgcctggatgatgtgagatataatgatattcttgtgtcagcatgtgcaaaatacgggattgccgcatttacaggagatggtctcgacagtaatgtgatggttgctgcgacaaaagcaatcgggaaaacagacggaatcggaatcccgactgtgaaaccatggaacatagataccgttgcggaaaagatgaagatggttcaggaatcaaaggcatttgcagtggcaatggatgtcgatgcagcaggacttccgtttcttaagaacatggagccgccggcaggaagtaagacagtggaggaacttggagagatcgcaaagattgcaggaataccatttattgtaaaaggtgttatgacagtcagaggagccctgaaggcaaaagaggccggggcatctgcaattgtagtatcgaatcatggaggacgtgtgctggatcagtgcccggcgacagcagaggtgctggaagagatcgccagggcagtaggggattccatgaggatatttgtagatggcggaatccggagtggtgtagacgtattcaaggccctggcactcggagcagatgcagtcatcattgcaagaccatttgtgactgccgtttatggaggtgcggaagaaggcgtaaagtcttatatagataagattggaacagagctggaagacacgatgaaaatgtgcggggtaacgagtctcaaagagatcaccagagcgtctgtctggatgaaataattaccagattcccatgatatgctgcattcccagactcacgatggtaattccgatccaacagcatccaccgagcataagtggttttccgccggatttaatcaatttcacaacattgctgttaagtccgatcgcagccatagccataatgataaagaatttcgacaattcttttaacggagcaaatacgtctgcactgacacccatagtcatacatacagttgtgatcacagctgcaatgatgaagtataagatgaacataggaaatgctctttttaagctgaatttgtttgatgctgagtcagcatttccagattttgcagcagattttgcacggatcagggacaataccagtgtgatcggaataattgccagtgtacgtgtaagctttacggtcacggctgtattcagtgtttcacttccgagattccacatactgtcccaggtagaggcagcagcggtgacagaagaagtatcattaatagcggttccggcaaataatccgaaggagcttccacttgtagtgtcaaagccaagtgtacttccaagtacagggaaaagtacggcagcgataacattaaagaagaagattacagagattgcctgtgcaacttcagtatcatctgcatcgatgaccggtgcagtggcagcgatcgcagatcctccgcagatggatgagccgacccctacgagaatcgaagtattcgatgggacattcatgatcttgcggagaacccacgcaatgatcagagaagtacttattgtacatacgatgatcggaagggattgctttccagtctgtagaataacaccaagattcattccaaatccaagcagtacaacagctgtctgtaaaataatcttagaagtccatttgatacctgattcggcttttcctttattggtccatactagtgtaatcagcattccggccaggatcgcgatgacaggtccgccgataaccgggaaagcctttccaagaagccatgatggaatcgcaatcacaaaacaaaccagtataccgtttaggtttttgttaaaaaaattcatgttttttcctctttctcattcttttattggttcatacgggtttccactagagattataacactggataacaataataaataattatataatattatcgaatgataataaaaaattattaaaaaatcaaattgacaatgaaaggaaaaagattatgctggattttagaacagatacattccttgcagtatgtgatacaatgaatttcacagaggcagcaagaaggttacatattacacaaccggcagtttcgcaacatattcgtttcttagaaaaggaatacgatgtcaaattgttttcttattgtaataaacagttgtatctgactcaggcaggagagatacttagaaaacggctgatgacaatgaaaaatgatcagctggcaattatgaatgagataagaaatgaatcccataagatggaatcactttccataggagttacgatgacgattggagaatatgcaattgtagataaaatagcagatttcctgatcagccatccggagataaacctgcatatacattatggaaatacaacgcagctgttgacattgcttgatgaaggaaggattaatcttgcgcttgtagagggcaattatccgaaggaaaattatgaacataaaaattacagtacggaagagtatatagcagtttgtgccagagatcacacattcaaagaaaaatttccagaaacaatgcaggaactggtgaaggagcgcctgtttgtacgtgaactgggatccgggacaagaaatattttagaggagttacttcttgcaagaggaatggggataaaagattttctccattatacagaagtggaaaatatgcatacaattatcgggcttttaaaaagagattgtggaatttcatttatgtataagattgcagtagcggatgaacttaagaatggaacattgaaagaaatcagactttcagattttaaaatgcagcatgcttttgactttatctgggaaaagggcagtatttatacagaaaaatatattggaatatgtgaggaacttctgaaaaaagagaatatcatatattgattagttgtacttatcgataatgaaagaaagtataaatcaggaaggatgggaatcatatgatgacaagagaagaagcattagcatacggaatgtcttttgacaatgtatatgaagaaaagccattccgtgatccaaactggcagctggtgcggatcaaaggaagtaaaaaaacatttctgtggatctatgaacgggaaggctatatcaatctgaatgtcaaagtgaatccggagtggagagacttctggcgctcgacgtatgagtcagtgacggccgggtatcatctgaataaagaacactggaatacgatcattctggatgggaccattccggaagaagagatcaaaagaatgatcgcagaaagctatgatctggttacggacagtccgacaaagagaatttatgaagcagtgaagcgtattccaaaagggcatgtggcaacttatgggaagatcgcagagatggcgggagaccccagaatggcaagagccgtgggcaatgcactgcataagaatccggatccagaacatattccatgcttccgtgtggtcaatgcgaaaggagaactggccggggcatttgcgtttggtggagaggatgtgcaggcagaacttcttcgggcggatggagttgaagtgataaacggccgggtaaatctagaaaaatacggaataaaagctgccagtggcagacttccagagatttgaacgccatgtaggatagaccagagggagagtgggaaaataactttttctatattccaggtggaatagtatgaagcgaagaaaccgggagacgatacattgtactgtcaccttgtggattcggagctgcaggtaaaataaaaaaagaaaagaagataaaaatgaaacagattgcaaagaaaataacagaatatgtaaagaaaagtaaaagagcaaagctatatggagtatttggtctgatatatttgattgcagtcatatttgtcatgaatgacgcatggttgtatcagacaccaattgcaaagctgacaaaagtagagacaagcgtggcaggagaaagcaaaagtacccgtggaacacaagaaatcaaatataagcaaaagatccggggggtgatattaaatggaacgaataaagggaaaatcgttgatttttctaatgaatatacctatacaggaatgttaaagcagaaatatcacaaaggggataaggtattgctaaatgggtctgaaaataatgtgggatctagtatacagtgtgtaaaaagagatacggaacttattattttgcttggtcttttaatattggtattgatgatgattgcgggaaagaaaggcttgcttacaattgtgacagtgggaatcaatattgtgatatttacagcaggattcctaaaaagcggtgatgatgcggatgttgtagcaatctgtaataaaatggtaatcttttttgcaattgctacattgatcggattaaatggaattcataggaaaacatgggcggcattattgtcaactatatgtgtattggcaatgatcatgggaatatttgatgtggtgatcagtcatagtgctgaattggattattctactatggaatatttggggagcattgataatccggatgagatttttcatgcagagattttgctatcaggacttggagcaatcatggatgttgcagtggcaattgctgtcgcattgagtgaaattgttacgaagcggccagaagttacatttcgggagttattccggtccggaagagagataggatatgatattatgggaacgatgatcaatgtattattgttcgtgtttggctgtggcttgattccgatgtgcgtgatcaggatgaataacagtgttcggtttatgacgattataaaattacatattccgtgtgaattatgcagattcttcatagagagtattggaattgtactggcaataccagtatctatactgatcacatctgtgatgatgaaattaacgataaggaaggtgaagaagacatgttgatgatactgggattgattctgttatttttgatcatgattattggcggggacagaggcgtgatatcattgatagcactggttggaaatatgttgctgcttagcctggctatctggctgatggcagcgggagcaccggtacttctggttacgatcggaatgggaatcatcatttcatgtgtaacattattttatcaaaatggtaccaatgaaaagacgaagagtgcatttgcagcagtattgattacaatgacggtcctgtttttctttatctatatggtggtgtggagaagtgaggcaggaggcctgaatgaaatccaggctgcggaagatgatgtattatattataatatgaatctggatattaatatgagaaatgttgcgacagccgtgatcatactcagcacgttaggtgctgtgttagatatggcacttacggttaccacttccgtttacgaggtcagtattcacaaaccggagatgaaactgacagaacttgtagaaagtggaatgcagatcggaagagaagtaatcgggacaacggtgaatacattgctatttgcgtatcttggagaatcactattattattttcttatctgaagatgcaggattatacactggaaacattattaaattcgaaaatattgttccagaattgtgtatcaatgatatttggtgcgatcgcctgtgtagtggtgatgccggttgcggctgtattggttggcaggcatttgcccgggtataatcattaactgattatatccggagcattattttggcagaaaaaataccatcttcataggtaaagtcacagacaccaccgtttttgtcggtaatgtggcggacggattcgattcctatgccgtttccggagcgtttggaggattggaaaacattgttttcttgttgtattttaccatcgaaggtattctccacatgaatcagaagcaggtgattatggtggggatacacctccacattaatctttctgcgggcgggttctgttttcacacttgcctggatggcattttccagcagattggaaaatacaaggcacagattaatctcatctatggaaagatcagtgggcagggaaaccagagcatgaaaaggaatattttctcttttggcaagtgtggaataatatccgaaaacactgtcaacagcctgattttcacagaaatggaggttatagtcagagattttttcggttgtagcggatagatattttttaatcttttccatgtcaccctgctctgccagagaggacagttggacaaaatgatggcggatatcgtgacgcgcctgtcttgcttcttcaatggccatgcagagattctcgtatctttcctgctgaagggaaagaaaatggttctcctgctgaagtcgggcatttctgttcaggctgaccgccatcatgagaaacatgacataaaacaggagcaggattatgagcagtacaagaattaaaacaatataacactgcaggacccgcccggtatataaagtgttgcggtatttaggaatcataaaaagattcactccgatgaagattaccggaaggatccagaatacataccaggtttgggcaaagttttcgtctgcgatcattgtctgaacacagtgacgggcaggataccaggctgccagaacaaacagcaggcagatgacgttatagaaaattccggcaccggtacgaaaccacagctcattttctgtaatatgcaggtcagcagttataagtgcattgactgcccgggaaagactgttgacacatgcaaaaactgcaaagactgccagaaaaatactgacggatttccagacagagatttttaacgttttaaaacaaattagttgattgtcttgaaaaatgcttgatttacgggcatattcgcaggtttgcaaattgattttactactcatttactacttttaacggattgagccttgatatgcaaaaagcacctgcgggctgccggatagaccgctacaccaccttacgcggcacgtcgaaaagaaaaaataaaataacaccacctataaggcggcgtttctcactcctacactggagaacaggaacgctgcttttttatgccctcatgttacgcagtaagggcaaatgaagccttgatttatgcggctcttagagcgcggaaatgagaaatgcaagggttgataccttttccctcaaaaccgcgtttctactgcgtaacaaatccaaccaaaggagtgatgaagctatggcagttttccgcgtggaaaagaacaaaggttatacggttatgagcaaccaccatttacgcaacaaggaactttccctaaaggcaaagggcttgttgtcgcaaatgctctcacttcccgaagattgggactacacccttgcagggctgtcccttatcaaccgggaaagtatcgacgctatccgcaccgctgtatgggagcttgaaaaagccggatatatcacaaggcggcagggacgcgacgagaaaggcaaaatgaccgctatcgagtacaccatttacgaacagccacagcccctagcattggattgtccggtattggaaaatccaacagcggataagccgatattggaaaatccgacaccggataacccgacgtcggaaaatccaacgcaattaaataaagaactattaaaaactaacttacccaaaaaagaaaaattaaatacagatgtatcaagtacccattccattcctttccattccctaaatccctctcccttagaggacgcggcacagccgccggaacggaagcgaaaggaagcgacagacgcatacagcgtgtatgaggaaatcatcaaggacaatattgagtacgactatctgatacaggacagataccttgaccgggacaggatagaggaaatccttgcccttattcttgaaaccgtctgcaccaaacgaaaaacaatccgtatcgccggggacgactacccggcagagcttgtaaaagcaaggtttatgaaactgaacagcgaacatatccgctttgtacttgactgtatgcaggaaaacaccaccaaaatccgcaacatcaagcagtacatgaaagctgcccttttcaatgccccgtctacgattggcagctattacacgtcccttgtatctcacgatatggcagatggtactttttatgggaaaccgaaaaaatccggcatacccgattacacctgcaacgagggcgaaagcctgtaaaccaacccaaaggaggatttgattatgacacagaaaacaggagctttgatttttgatgaaaccgctgaccgctacgacattcgctttgacgtaaacgactactacgggggcttacattgcggcgactgcatggaggtctttgtgcggggcaaatggaagcctacccgtatggagtacggggacaactggtatcttgtgggtattcgggcggcagacctttccgggctgcgggtacggatttaacagggcggcgtgaaaacggacgctcttttttcagtttgcgcgccatgggcgcgctctaacgggtgtaagtcccgaacacgcccagagcaaggtgataggtaggatgaaaaagagatatttcttgtatgcagttttgaaggtatatataaaaggtaaaaagcaatcaacatatgttggttgctttttaattgttattatactgaaaatgtgctaaaattaacgagaaatacggccggactcatgaccgtaaagatcatatttatttttttgaaggaggaatctaatattatgattacctggaacaacttagatacccttgcatcattcaaagaacttgaaaaagttgagcgagtaaatcttgtagaagcaatgacaggagaaagcggagcagaacgagtaaagaattacagtgttccgatggcagaaggacttacttataactatgctgcaaagcaggttgacgataaaatactggcagcacttgcaaaattagcagatgaagcacagctggcagagaaatttgaagcactttacaacggagaagtgatcaacacaggagagaaacgtctggtacttcatcacatgacacgtggacagcttggagaagctgtagaggctgacggagtggacaagcgtacattctatacagaacagcaggctaagatcgcagattttgcaaataaagtacatacaggagagatcacaaacggagccggtgagaaatttacaacggttgtacagatcggtatcggtggaagtgatctcggacctcgtgcaatgtatcttgcacttgagaactgggctaagaagaatgacacattcaagatggaagccaaattcatcagtaacgtagaccctgatgatgcggcagctgtacttaattctatcgatgttgcacattctatcttcgtactggtatcaaaatcaggaacaacacttgagacattaaccaatgaatcatttgtaaaagatgcactgaagaatgcgggactggatgcttctaagcacatgatcgctgttacaagtgagacatctccgctggctaagagtgacgattatcttgcagcattcttcatggatgactatatcggaggacgttattcttctacatctgcagttggaggcgctgtattatctctggcattcggaccggaagtatttgcacagttccttgatggtgctgcagcagaagatgcactttctaagaacaaagatgtattcaagaaccctgcaatgctggatgcactgattggtgtatatgagagaaatgtattaggatatccaagtacggctgtacttccatactctcaggcgctgagccgtttccctgcacatttacagcagttggatatggaatctaacggtaaatctgtcaatcgtttcggtgagccggttaactatcctacaggaccggtcatcttcggagaaccgggaacaaatggacagcattctttctatcagttactgcatcagggaaccgacattgtgccgttacagttcgttggatacaagaacagccagatggcaacagatgttgtgatccaggacagcacaagccagcagaaactttgtgcaaatgtagctgcccagatcgttgcatttgcatgtggtaaatccgatgagaaccgtaataagaatttcgaaggcggacgtccatcaagcatcattatcggagagcaggtaaatccgggatctctcggtgcacttcttgcacactttgagaataaagttatgttccagggatttgtatggaatgtgaacagctttgaccaggaaggtgtacagcttggtaaagtacttgcaaaacgtgtacttgcacacgagacagagggtgcactgaaggtgttcagtgatctgttgaatatctaataaattaaagaagcaatcacttgttagtgtgattcaatagtggtatgatagtgctgttaggcagaaatgtctgtttgacagcactatttttttgatgaaaggaaaataaagacgtgacctataaagaagcgagggtatatttggacgagatgtcgaaatacggaagtgtacttggcttagatacgattcgaggtctgttgcgtgaacttgggaatccccaggatgatttgaagttcatacatattgcaggaacgaatggaaaaggatctgtgcttgcatacacttcaatgatattaagtaaggcaggatacaaaaccgggcgatatgtttcaccgacagtcatttcttatctggagaagatacagatagatgggaaatggatctctgaatcagaatttgcagagatcatggaagagataaaagaagcaattgaccggcttgtatgtaaaggagaacctgttccgacagtgtttgaagtagagacggcgatggcttttttgtattttaagaaacaaaaatgtgatctggttgtattggaaactggtctcggcggagagacagatgcgacgaatgtaattaagaatacagtttgcgcagtatttgcaacgatcagtgttgatcatctgggggtgatcggagataccctggaagagatcgcacagacgaaatccgggatcatcaaaccgggatgtacggtagtgtcagcaagacagcaggagaatgtcagactgatcctgcgaaagaaagcagagagtctgaactgtatatacacagaagcagagccggaacagatgagtatcgaaaaagaagattataaaggacttacattttcatataaaaaatatgcgcatatgcagaaccacattgcaggagagtgccagagagaaaatctttctgtggcactggaagtaattgaaagcctcaggaagctgggatatcagattgaggaaggagcagtgagggacggtcttgatgcaacgagatgggcgggacgttttacttgtctatctgaagatccggttgtgatcgtagatggtgcgcataatgaagatgctgcgaagaagcttaagacatccattgaacggtattttacgggagaggaacttatcctgatcatgggtgtatttaaagataaagaatatgagaagatcgtacagattctgtgtccgtcagcaaagcgggtgtatacggtagatctgccgaataaggaacgtacactgccggcagagaagcttgcagaatgtgtaagagactgtatgacagaacagatgagcgtgtacgcagaaaagagtattggagatgctgttgcaaaagcgtacacttatgcaacagaagacagtgggaaacgcgcggtgatcgcatgtggttcattgtcatatctaagtgaagtaatccggtgtatggaaggatgcgtacagaatccgcagagaaaggaaagaatatgatagatcatgagaagatagaacaggcagtgcggctgcttctggaaggaatgggagaagatgtgaaccgggaaggactgattgatacaccggaccggatcgcaagaatgtatgaagagatatatggaggtatggatgaggatgcaggaaaacatctttctaagacatttaccgttgacagtcatgagatggtaatagagaaagatattacattctattcgacatgtgagcatcacctcctgccattttatgggaaagcacatattgcttatattccggatgggaaagttgtaggattaagcaaacttgcccgtaccgtggaggtattcgcaagaagactgcagcttcaggaacagcttaccggacagattgctgatgctttgatggagtatatgcagccgaaaggggctatcgttatgatcgaagcagagcatatgtgtatgacaatgcgtgggatcaagaagccgggaagccagactgtgacaattgcaagacgcggtgtatttgagacagatctggtactggaagagagatttttccggatgcttggacgataaaaagaaagagatacagatgtagatgaaaagagtaacagaaagacaaaaagggatgccccgtctgaatgcggtggtgaatcatgaagtgtatcagacatactataagcgtatctgtgaatgtgagacggatagggtattttgttgtcatcagatgaaccatcttctggatgtggcaagaattgcttacattaagaatctggaagaaggacttggattcgataaggaactgatctacgtagcggcggtgctgcatgatattggcaaatcttttcagtacagacagcagattccgcatgagatcgcaggagagagaatagcaaggcggatattggattctcttccgactggttttacatttacggatgaagaaaaagcactgatctgtctggcagtcaggggacaccgcagacggcatgagcatatgaagccgatagaggaactgttctatgaaagtgataaacgttccagaatgtgtctttcctgcatggcagagaagaagtgtaactggaatgaagaagagaaaaatatggagataataatatgatcataggtggaaagaattttgatacagcaaatcatacatacattatgggaatcctgaatgtgacgccggattccttttccgatggaggaaagtttaacggaatggatgcggcaattgcacatgcacaccagatggttgaagaaggtgtagatatcattgacgtaggtggggaatctacgcgtccgggacatatccagatcacggatgaagaagagattgcaagagtgacgccaattattgaagtgcttaagaaagaatttgatgtaccggtgtcgatcgatacctacaaaagccatgtcgcagaggctgcacttcaggcaggtgcagatcttgtcaatgacatctggggattaaaatatgacaagaagatggcaagtgtgatcgcaaagtatcaggctgcatgctgtctgatgcataatcgggaaaaggcggaatatcaggactttctgaaagatttcatggatgatatgaaagaatgtgtaagacttgcaaaagcagcaggcattgaggatgacaagatcatccttgaccccggtgtcggatttggaaagacttatgagatgaacctggagattatcgataagatggagatattaaatgaacttggatatccggtattgctcggaacatcacgaaaatccgtaatcggactgacgctggatcttccggtgacgcagcgagaagaaggtacgatggttacgaccgtatatggggtacagaagggatgtgcattcgtacgcgtccatgatgtagagaaaaataagagagccattcagatgacgaaagcaatcatgcggggacacgaagtatagaaagagtgaggaatgagatgaaaccggacaagataaagatagaagatctggaagtatttgccaatcatggtgtgtttccggaggaaaatgtactggggcagaaatttgtggtgtctgcggttatgtatacggataccagacgggcaggactgacagatgagctgactgcatctatccattatggagaagcaagtgcatttatcacagagtatttgaaaagtcatacgtttaagcttctggagaaggttgcggaaggactggcagaggagatgctggtgcgtatagcaggtctgcagaaggtgcagattgagatcaagaaaccgtgggcaccggtcggactgccgcttaagacggtcagtgtagagattgagcgtgaatggcatacggcatatattgcgctcggatcgaatatgggggatagcagaagcattttggaagccgcggtacaggcgctggatgagatgaagaatacaaaggtggagaaggtatcgacatttatcacgacacctccgtacggagtgacggatcagccggatttcttaaacggttgtctgaagctttcgacattattatatccggaagagttattaaaagagctgaaccgaattgaaaaagaggcaggaagagaacgaatcatacattggggaccgagaacactggatctggatattatattctatgacgatctggttgcagagacggatgctttatgcattccacatgtcgagatgcataagagagcgtttgtactggagcctttgcatgagattgcaccttataaacgtcatccggtgtatgggaagacggtcagagagatgctggaagaccttcggaaatagaatgacagagcatgaacaggacagtaaatttacaaaaaataaaagacaagatggggaaaacaagatggatattcaggagtggattatatttgcaatcgaactgatcggaacagtagcgttctcagcatcgggggcaatggttggaattgagtgcagcatggatatattcggagtgatcgtgcttggtgtgtcaacggcagttggcggaggtatggttcgtgatgttatacttgggaaggtgccatcggcacttctgcatccggtatatgtgatctatgccgtacttgctgcggtgcttgtgttttgtattatatatttccgcaggaaatatctgcaggatggttttggtgaggtctatgataaacttatgttagcaatggattctgtaggacttggaatcttttcggcgatgggagtgacaaaaggtatcagctgcggctatatcgacaatacatttctgctggtcttccttggtacaatgacgggagtcggaggaggactcttgcgtgatacgatggcaggagttgcgccgtatatatttgtgaaacatatttatgcatgcgcatccattgcgggggcgtggatatgtgtgatcatatacagaagttacggagaacttccggcgatggtggtgtcatcactgatcgttatgctgatacgttttcttgcggctcattacagatggaatcttccaaggatcggagagtaaaaatccgggaaggcaaggagtattttgcaagatgagatgaaaaaatatgcaaaatcatgcaaaatcatgcaaaattatacttgacatttgaaatgacaggtttataataaggacttgtaaaaacacatatagttcaccgaaattcgttgatgagaacaatgccgtatctatcgttatttcacagagagcctgcggttggtggaagcaggtaataagcagataaggatatcctctctaagaagcgggttgaaagcaatatcaaagtaaacttcgccggtatcccccgttacagggagcatgtatgatggtacgtgaatgagagctgtagaaagattctacagaattagggtggtaacgcggatagatttcgtcccttttcagagtatattctggaaagggatttttttttggtggacagtgattgcttaaaggaggagaagagtaatgaaagcattacaaaaagcaagcaaatttttatcagactacacgtcaattgttgtaatcgcaatcgcagtggttacatttttccttccgtctatgatgggctgggtaaatctggcactgttcacagacatggtatcgaacaagttcacatgtcagtctattatcattggtattatcatgttcagtatgggactgacacttacaacggaagactttaagattcttgcacagcgtccgtttgacatttgtgttggtgcggttgcgcagtatctgatcatgccattccttgcatttgcgctttcaaaggtattgaatctgccggatggaatcgcacttgggctgattcttgtaggctgctgtccgggaggtgtatcttccaacatcatgtcttatctgtgcggcggggatgtagccttttctgtaggaatgacaacagtatccacactggtctcaccggttatgacaccactcatggtatctttactggcaagcggtacacagattacgatcaagggacttccgatgttcgtatcaatcattgagactgttatccttccggttggtgttggatttttgttaaattatctgttgggaaagaataaaacattccgggaacttcagaaagttatgccgggagttgctgttctcggacttgcatgtgttgtcggcggtgtggtatcttcacagggagccaagttcttccagtcaggtgttgtgatcttcgtagcagtattactgcacaacgggcttggatatctgcttggatatggagcaggaaaactggttggtatgaatacgtcaaagaagagaactatttctatcgaagtaggtatgcagaatgccggacttgcaacgaatcttgcaactacaactgcccagtttgcatctacaccggaatctgcaattatctgtgcggtatcctgtacatggcattccatctcaggaactctgttagccggattatttgcaatgcatgacaaacgaaaagaaaaagctgccggaaatgtagaggcagcagcacattaagctgctctctgaatgtgtgaagcaataaattatagaatagaaacaaaaaagaaacaacacgggatgtgctgtttcttttttttgtgtgcgccaatatggataaagattatcaacgaaataaaaaaataatttaaataaaatattgactactggtcattcttggctataataataaatgcataaagaaaataagaggagatggaaataatggtcaaagttggcaaatggattgcccgacacagaatactgatgctgcttataggagtcttattaattattccgtcagtaatcggcatcgcaaagacaaaagtaaattatgacctgctgagttacctgccggatcacctggagacggtaaaagggcaggatatactggtagatgaatttggaatgggtgcgttctccatggtcgcggttgagaacatggatatgaaagacgtacagaagctggaaaaagaatttgagaaagtgccacatgtacaggatgtactctggtatgacgatgtgacagatatcagtcttccgactgagatgatcccaaaagatatcagaaaagcgtttatcaatggagatgccacgatgatgctggtattgttcgatgatacgacatcatccgataattccatggaggcactgacacagcttcgtaagattgcgaataaacagtgtttcatcagcggtatgacaggtatcgttacagatattaagaacattgcaatgaaagaacttccaatctatgtagtaattgcagcacttctgagtctggtagttctggagattacatcaggatcatttgttgttccgtttctgttcctgttaagtatcggacttgcgattctgtataaccttggaagtaatattatacttggtgaaacttcttatatcacacaggcattgacagcagtcctgcagcttggtgtaacgatggattattccatcttccttctgaatagttatgaagagaataagaagagattccctggcgagaaagaaagagccatggggcatgcgattgccaacacattcaaatcagtagtcggaagttccgttactaccgtagccggattcatcgcactgtgtgttatgacattcgcactcggacgtgaccttggtattgtaatggcgaaaggtgttgtgatcggcgttatctgttgtgtaacgatcctgccggcactgatccttgtatttgataagccgattgaaaagacaagacacaaattactgttaagcaacatggatcgtccatccgcttttatcacaaagcattataaagtatggatcgtagcatttcttgtattattacttcctgcaatttacggtaataatcatacaaagatctactacaacattgcagattcacttcctgcaacactgaacagtaatgtatcgatcaaaaaagtaaaagatgactttggtacaagtaacatgcacatcgtcatgatggataagaacatgagtgccaaagataagcagcagatgttcaagaagatcgataaagtaaaaggtgtaaaatggaccatcagcatgagttcactgatcggtcctagcgtaccggattccatgatcccaaaggatgtccgtaagatgatgcagagtaaggattatgaactggcattcgtcagtacgaaatatgaatccgcaacagatccggtaaatacacagatcaaaaagatagataagatcgtaaaatcctacgataagtcgggaatggtcatcggagaggcacctctgatgaaagatctgcaggatgtcacggatgtcgatcttgttaatgttaatattatctctatcgcagcgatatttgtgatcatcctgattattttcaaatcgatttcactgccggtcatcctggtggcagttatcgaatttgcaattatgatcaacatggcgatcccgtattatcagggaatcagccttccatttgtggcaagtatcgtgatcggtgccattcagttaggtgcaactgttgactatgcgatcctgatgacaacgagatatcaaaaagaacgaagccttggaaaagataagatggaagcaatcagcattgcgcataaaacaagcatgccgtccattatcagcagcggacttagtttctttgcagcaacatttggagttgcctgctactcacaggttgagatgatcggttcgatctgtacattgcttgcaagaggagcaattatcagtatgatcgtagttcttctggtattgccggcaatgtttatgatatttgacaaattaatctgtaagacatccatcggatttcttgggaaaaaggcaaaagcacagacaaatgaagcaaagtaacctgttattaacaatccatcataattaagaaaggaagcaggaattatgaataagaataggaaaatgaaaagaaaagttgcagcatctgtagcagtcggaatgtcagtgatgatgggtgtaacaccggctttcgcggcaaatggaacttcaaacagcgaggtatataaagaagagacggtatatgtgaatgccaaagcaagcggcaagacagataaagtaacggtatccaactggcttaagaattcaggaagtgtatccggagatttggaagacgagagcacactgagcgatatcaagaatgtaaaaggtgatgaaaaatatacgtcagacggagataaactgacctgggctacagacggtgaggacatctattatcagggaacgacagataagaaacttccggtatcagtaaaactgaactattatctggacggaaaacagatgaagccgtctgagttaaagggtaagagcggacatttgaaaattaccgttgactataagaataatgaaaaacagaatgtatcgttggatggaaaagatacagaagtatatacaccgttcgtgatgatgacgggaatgatacttccgaatgagacattcagcaatgtaacgattgataacggcaagattatttccgatggaaataagaatatcgtggtcggattcggaatgccgggattaaaagacagcctgaacttaagcagtgaagaaagtgacaaagttacgattccggaaagcttaagtattgaagcagatgtaacagattttacaatgtcttctacttatacagttgcattatctgatctgttggatgatatgaatatggatgacattgcagatgtagatgatctgcagacagcgctggatgatctggaagatgcggcacttcagttggttagtggttccgatacactggcagatggtgcaggaacactggcagatggtgtgaatacttatacagaaggtgttgacacattgaatgccggtattcagaaatatcttggttctaacggagagttaagcggcagcgttacagagtatgtgaatggtgtgaataaagttgtcaaaggggtacaggattatacggatggcgtaaatacactggcagatggtgtaagcagttacgtagacggtgagaagcagctggcagcaggagcttcacagctgacacagcttagtgcgggactgaagcaggtgcaaagtgcaatctcccagcttgaggcagcaacgaatggtgagggtggaaccacagaagaccttcaggcagcctccaaggctctggcagcaggaacagcacagatgaaagcaacactcggaacgaaagaagtagagagtctgatgtctcaggtaaatgctatggtaacaaccggcaatacattgatggcagagactaagacattaagcggaacacttgcaaatggtatcgaggcaccacttacaacaattgctcagacattaaatggtatgcaggaggctctggcaaatattgatgcagcgcagacagcattacagaatgcatgtaagaatatcaatgatgtagttgcatctgacaatcagacaattacaacagcaaagacaacagcaaagaacagttccgatgcgattgctgcatctataagcgcactggaagcgaagtatgcaggaatctcagataagaattccgaggaagcaaaacaattacagagttcgatcagtgcactgaagagcgcaaaagcttccacagattccgtacagaatctcaaagagttatcaggcattgatacgtcaaagatgccgacaatagatgtagattccttaaaagcaggtgcggcaacgatcatgacgaatgcagatactttgaagaagtcttcgggagagctagcagcagcacttccggaattacagaagcagttgaagagtatcgaagatgcggaaggtgttcttgcacaggcagggcagttaagtacattaacaggaagtgtagaccagttaaatgcaggtatgcagggactgaacagtgcgatcggaacactgcatggtaacctggctgcattgaacaaagccacatcagcgcagttcccgacagcaatccagggaatcacagccctgaataaaggctttgcccagttaagtggatacaatgattctctggtaagcggtgcaaataaactgaaatccaacagcccgacattagtagccggtgtcaatacacttcaaagaggaacgaatcagttggcaagcgggctgaatacattgggaagccagatgtcttccggatctgcaacacttgcggccaacagcagcgcactcagaagcggagcttccgaacttcagtcaggggcaaaagaacttgcagaaggcatggcgaaatttgacaaagaaggaacaagtaagttgaagagcaccgtggaagatgaacttggtgatgtacttgacagaatcgatgtactgacatcagaaaattgcaaatatagtacattcagcggtaaggataaagcaatggatggtaatgtaaaatttgtgattgagacggatgcgatcgagtaaataatatgaatatgaaataaaaagaatcacaggtggaagaggatgaagtaatatgttccctgttaattagacgaggggcgtattacttcatcctcttccgtttgtgattctttttttattttttcaacattctccagagagtgcttctgcttatgccaagacgtttggcagttttttctttattcccatgttcttcagcaagaatccattgtatgatttgagaagacgataaattagtcttattatctttccttgaaattccctcgatatagtgctaaagtatactaaaaaggtatgatttagcgagtgcgtgaaaaaacatgcactaaggaggaaaattcatgaatgaatacagaataggaacaaaatgtgtacagggcggatatactccgggaaacggagaaccaagacagattccgattgtacagtcaacaacattcaaatatgcaaccagtgaagatatgggaaaattatttgatctggaagcgtcaggatatttttattccagattgcagaatccgactaatgatatggttgcggcaaagattgcagagatggaaggtggaacggcagcgatgctgacttcatccggacaggcagccaatttcttcgcactgttcaatatctgtgagtgcggagatcacattgtagcatcttcatccatttacggtggaacatttaacctgatcgatgtaacgatgagaaagatgggaatcgatgtaacattcgtgtcaccggatgcaacagaagaagagttaaatgaggcatttaagccaaatacaaaagtaatgtttggtgagacaattgccaatccggcacttaccgtactggatattgaattatttgccaaagtggcacatgcacatggtgtgccgcttatcgtagataacacattcccgacaccggtcaactgcaggccgtttgaatggggggcagatattgtaactcattcgactacaaaatatatggatggacacggagctgcacttggcggtgcaatcgtagacagcggaaagtttgactggatggcacacgcagataaatatccgggactttgcacacctgatgaaagctatcatggaattacatatgcggagaaatttggcaaagaaggtgcattcattaccaaatgtacggctcagctgatgcgtgacttcggatctatgcagtcaccacagaatgcattcattttaaaccttggtctggaatccctgcatgtacgtatgccgaagcacgtagagaacggacaggcagtcgcagaattcctggaagcacatccaaaggtagcatatgtgaactattccggacttccgtctgataaatattatgaaagagcacagaaatatcttccaaacggaggatgcggtgttgtatcgttcggattaaaaggtggaagagaagcagcgtctacatttatgaagacattaaagcttggtgcgatcgagacgcatgtagcagatgcaagaacctgttgtctgaatccggcaacgtctacacacagacagatgacggatgaacagttaaaagaggcaggagtaccggctgaactgattcgtatcagtcttggtctggaagataaagaggatctgattgcagatatttcgaatgcgttggatgcaatctaaggtagaattgaaagagtaaggcaaaattccgaaaaggatggtagcgacactaaggggataagtttatatccccttttttttgacgtttttatagcaatcatgctaaaatagagaaatctaccatgtgtatggaatattttgagccggcagggacagtaaaaagaccaaaaaccccgtccccaatggctggagagggaaaattatgaataaaagagaatcatttagcagcagatggggatttatctgtgcctgtatcggttcagcggtcggtatgggaaatatctggatgttcccaacaagagtatcattgtatggaggcggttcatttctgataccgtattttatatttgtaatactgatcggttcgacgggagtgatcggggagatgagttttgggcgtgcggcaaaggccggtccaatcgatgcatttggaattgcctgtgagaaaaaaggaaagagaaaagtcggagaagcactggggatgatccctgtattcggatcacttgccatggcgatcggatatacggttgtaatggggtggatcctaagatatgccgttggaacatttacaggagcaacactttcgcctgaaaatgtggatgaattcggggcggcatttggtaagatggcatcagcatttggtaataatatatggcagatacttgcgcttgtggcctgtatgctgattctgatgttaggtgtcggaagcggcattgaaaaagcaaataagatcatgatgccgatattcttcgcattgttcgtgattctgggaatttatgtcggattccagccgggagcaagtgaaggataccgttatattttcagagtagatccagaggcattcaaagatccggcaacgtggatctttgcacttggtcaggcattcttttccctgtcggtagcaggaaatggaacattgatctatggatcttatctttcggatgaagaggacattccggcttctgcaggaagagttgcattatttgatacgattgcagcaattcttgccgcactcgttatcattccggcgatggcaacaacgggagcgcagttggatcagggaggtcccggactattgttcatctttctcccgaatctgatcaaaggaatgccgggaggatggctgatcgcaatcatcttctttgttgcggtattacttgcgggtatgacatcgttgatcaacttgtatgaggctccgatcgctacggtgcaggaaaaattcaagcttggaagagtgccggcatgtgcatttacgggaattgtgggagtgatcgtgtccctgctgatccagggcatcgtgtcagactggatggatgtgctgtctatctatatctgtccgcttggagccgggcttgcaggaatcatgttcttctgggtatgcggtaaggcattcgtggaaaaacaggttaatacaggaagagagacaccatttacgaaacagtattatacaatatgtaaatatttttatgtaccggtatgttttattgtgctgatccttggaattgttctcggaggaatcggttagaagaaaaaagaaatgagaggataaagaagaatgaaaaaaggaaatgcggcagcattactgccgataggcgtatttttgtgtatctatctggggcttggaatcgcattcgaatatgtaatgaagattccgatgggattctataatgttccgatcattatcgcatttcttgcggcgattctggtggcatgcctgcagaaccgcaagataagttttgacggaaagctggaaatcatggcgcaggggcttgctgataagaatattattacaatgcttctgatcttcctgacggctggggcgtttgtcggagtggtaggaagaagcagtgcggaaagtgtggcatatttcatgttgtcactgattccggcaagattttcagttgcggtattatttgtggtagcctgttttgtgtcggttgccatgggaacgtcggttgggacaattacattgatcacgccgatcgcagtgtccgtatccaaggcttcgggatttgacatggcactttgcatcggttcggttatgggaggatcaatgttcggagataacctttcttttatttcagatacaacgatcgcagcatgtaacggacagggatgtcagatgaaggataaattccgggagaactttggaattgcacttccggcagctattgcaacgctggtattgatcctggttctttcatttcagacggatattgcagggcgggtaagtaagagttataacttagtgcagattattccatatgtactggttctcataggaggaattatcgggatcaatgtattcgtggtacttctgatcgggattgtatctggttctattattatgctggctggcggtcacattgcggcgacagatctgcttgccaatatgggttccggagcttccgggatgttcgagacgagtatggtggcaatcctggtggcagcgatgtgtgcactgatccgtgaatatggtggttttgatgcattgctggcaggaatccacaaagtattcaaaggccgcaaaggcggtcagtttggtatgggacttctggtcggaacgatggatattgcaacggcgaataatacggtggcaattgtcatggcgaatccgatcgcgaaggatatggcaaaagaatatgggatcacaccgcgaaaggctgcttcgatactggatacattttcctgtatttttcaggggatcattccttatggagcgcagatgctggtagcaatctctgcggcaagtgaactgggatatcgtgtgtcggcatttcagatcatgccgaagcttttttatccgtttttattatttgtgagttctatgatatttatctttgtgattccggcaaagaaagagaggtaaattgtgaaagaagagatcagacagaaactgacaggtgcagtcatcggacttgcaagaacctgtgagaataacgaaaagacagagaacactaaccgggtattcttagaagcactgacggcggccggagactggtcggcaagtacctttgatatgagtgagatgttagaaaaggtaagaaatgaaaaatatacagtctcaccgggatgtgtaacatgtgcagcaccatgtggcaatacggatgactatgatatggagaatctgtggaaagaatccgaagaaatcggagcatttaagaatacaatcctgatggtaatctgccagactgcagcaaaattgtatcatgcagatcagacagaagaatctgagacggtgaagttattattccgtgcattatgtatgatcagttttgaaggctgggatgttgcagggcttacaccagtgatggtggaacttggaaaagcaggacggatataaaaataaatagaataatattagcaaaaaagactttaaaagggattcagaaaaatctattccaaagtcttttttttgtcatccattcaaaagaagtattacttatgaaagataagaaaaattatctgatttaatagaagattaaagataagaaatgcgttataataacaatacactgtatatatcaaggaggaacaaaaacatgacagtaccagaaagactttccgcacttcgtaagtgtatggaagaaaagaacattgatgtgtatgtagtaccgactgccgactttcatcagagtgaatatgttggggaacatttcaaagcgagaaagttcattacagggttctcaggatcagcaggaacggccgtgatcacaaagacagaagcaagactctggacagacggacgttacttcatccaggcagcagcacagttggaggggacaactgtagaacttatgaaaatgggtgagcctggtgtgccagagatgaatgcatatattgaagaggtattaaaggaaggcgagacacttggattcgacggaagagtcgtatctgtcggtgaaggagaaggttatgcagccatcgctgggaagaagaatgcaaaagtaaattatcaggtagacttaatcgatgagatctgggaagaccgcccggtattatccgaagagcctgcatttaatctggatgtaaaatatgccggagaaactgttgcaagcaaacttgcaagaatccgtgaagagatgaaagaagcaggaaccaatgtgcacgttgtatctacgctcgacgacatctgctggacgttaaatatccgtggaaatgatatagacttcttcccactggtattatcttacggaatcatcacaatggacagtttcgagctgtatatcgatgagagaaaattagatgacaagttaaaagccaaacttgcaaaagatggcgtaaacttacacccatacaacgacatttacgaagacgtgaagaaatttggcagtgatgtggttgcaatgatcgatcctggaaaactgaattatgcattgttcaacaatattcctgaaaatgttaagacagtaaaaaagagaaatccggcaattctcatgaaagcgatcaagaacccggttgagatcgagaacatccgcaaggcacagatcaaagacagtgttgcgcatgtaagattcatgaaatggctgaaagaaaatgttggcaagatgaggatcacagagatgagcgcatctgataaattggatgaattccgtgctgagatgggcaaatttatccgtccaagctttgaaccaatctcttcatttggagagcatggtgcgatcgtacactacacatcttcaccggagacagatgtagagttaaaagaaggacagttattcttaacggatacaggagctggattctatgaaggttccacagatgtaaccagaacttacgcactcggcgaagttccgcagatcatgaaagatcacttcacattggttgcgatcagtaacttacagcttggcagtgcaaaattcctggaaggttctaccggtatgattcttgacatccttgcaagaaaaccattctgggacagagacttaaacttcaaccatggtacaggacacggagtcggataccttctgaacatccacgaaggacctgcaggtttccgttggaaatatcgtaagggtgagacagaagtattacaggaaggcatggtcatcacagatgagcctggaatctatattgaaggatctcacggaatccgtctggagaacgaactgttgacctgcaaaggaacattgaatgaatatggtcagttcatgtacttcgaagcaatcaccctgattccaatggatctggatgcgatcaatccggatattatgacacaggaagacaagaaactgttgaatgattatcatgcaaaagtatacgaagtgattgctccttacctgaacgaggaagagcaggagtggctgaagaaatacacaagagctatttaacctgtgaggacggatttttcagcgttttgcttctaaatgagaaatgatattcatataatgaattgacaaagaaataaatactaagtagaatctaggttagctatagctaacctagattctttttagtaaaggagttctttatatatgaagaaaaaattccgaaatcaatcaaagaataagacatttaattttttacgttatctgggaccgggccttttggtaacagtaggatttatagaccctggaaactgggcttcgaatattgcggcgggctccggattcggatatgagctattgtggatggtgacgttatcgaccatcatgctgatcatattgcagcacaatgcagcacatttaggaattgcaacgggactttgcctttcggaggcggcaagcagatatatccaaaggctgttaaagaatattattcttctgtcggcaatgcttgcggcagtagcaactgcgatggcagagatgctgggtggtgcaatcgcattgcagatgctgtttcggataccaataaaaataggaagtatgttgattcttgcagtttcccttttatgtgcatttacgaatgcttataaaaggattgagaaactgatcatcatatttgtatcgctgattggattttctttcttatttgaaataggaattgcgaagatcgactggggagcagccgcagtcggatgggtgaaaccttcgtttccagcgggaagtatgccggtgatcttaagtgtattaggagcggtagtaatgccgcacaatctgttcttacattcggagatcatccagagcagacagtggaacctggaagatgattccgtgatcaaacagcagctgaaatatgaatttaaagatacattattttccatgatcataggatgggcgatcaacagtgccatgattctgatggcagcagctacgctttatcagggcggaaatgggaggcagattgatgatttgacagttgcaggaaagatgttgtcgcctttgatgggaaatgcggcgacggtagtctttgcactggcactgttattggccggtatctcatcgagtatcactgctggaatggcaggtggaacaattttttccgggatctttaatcagccatatgacatgaagacaaaagagacgaaagctggcattttattgacgatgattctggcagcggttgtcatcctgtttatcagccagccgtttaaaggtctgatatattcccagatgctgcttgcgattcagcttccgattacaatatttacacagatatatctgacctcatctgaaaaagtaatgggaaaatatgtgaacagcagacgtttgaattttttgcttctggtgattgctgtgattgtaacagggctgaatatagcattgctttttgtatagacaggaagaacagaataagaagaaagaaaaaccgggcactgtatagaaacaggctcggtttttttgtatcaattattcggttacagcggaagcggcaacgttttctttctcaggaaacatctttctgaagatcagacggatgaatggtccgcagtagaagatctgccagaagaaagcaaccgggaagttcatgaatgttgtctgacaccaggtagcaatcacattacttcctgcgttcttgaacagaatcgttgcaacaagactcatgcaagggcacatgatgcatacgatcatggaagagattgcaagagtgatgaagattggtctgtcctgtggtgtaacgatacggaaggcaagcatatgtgcaagtttgtcaacgaaagcaaattccagaacgaaggcaaccggccacatgattttcagttcgccgaaagccatcaggaatacttcgttgctcattcctcccacattcaggcagatattgtaacaaatcatgacgtataccatcagaaaagacatcatcagtgtaaaaataacattttgaaataaagtttttggcataatttttgttctcctttttatgaaatatttaaaaatgggtacaaaaaagacacttgtgttgttcgttaatcaagcatacacttgtgtcgtttccaattaaaccaaaattatcttatttttttgcccgaatatgaattataccgaacgaaaagctaaaaatcaagtatttttttacataacatccggaagtggatttatgacacttctcatttcagttttgatcattctcggtgcggtgtcgacagccgtcaatatgattgcggcaatggtaaagcgtatctgtaacgggattgagaagcgtttattaaaaaagggcaattgattaaaactcaattgcccttttaacggcttcaatatctcccgtaaacaagatgctctccattccaagttctttacttgcaatgacattttccaccgtatcatcgatgaagaagcattcacttggtagaaggtcatatttattgaacagatggtaataaatatcgtgtcccggctttgccatctttagaggtgcagagaagacgatgccatcgaattctttcaggatcggataatctttcggtgcacgttctgcaaacctggtagaagcgttggaaagcagatagatcggaactccccgggcttttaactctttgatgaatttccatgtttcaggaagcggatcgacatattggaaccagttctcgaaaaaatcgcgggcagtatctttcagacggtccggaagttctgcaatcgtatcttcggcattctggtcatagtcgatagttccggcatctaaagctacccagtttttaaaaatggcatcagcaagaatattataatcttccggtgtagaagcaaatttccccaggatatagtctcctttaaattttccgattacatttccaaagtcaaaaataatattcttgtatctcatcttaagttcctccctgtattttatactgcctgttttatatttttataaacattattatagccttatagatagaaggaatcaatatacgaatgataaataacatgtcaatataagtatgattaatagaaggatgtcaggtttttgtgagattgacaatcatcaggaaagtgtatatgattttcggtaggactgtaaaaggaaagagagattattatggaaatcagtatacttttaatggaacagatcgcagaactgtttcttatgatcctgatgggatatattattgtaaagacaggattgttaaagggagatgacagcaaagttatttctaaaattgtattatatcttgttatcccgtgtgtgatcatcaatgcatttcaggtggattatacgagtgaaaaagtgaaggaacttttgctggtatttgcagcgtcggtattattacaggttatattactggcagcagtgtggggtgttggaaaggtattgaaactaaatgaagtagagatgacatccatctattattcgaattcgggcaatttgatcgtaccgctggtgacttttattctgggaaaggaatgggtattatacggttgtgtattcatgagtgtccaactggtatttttgtggacgcatggcaagaatacgatcagccgggaaggaaagtgggactggaaaaagattgtattcaatatcaatatgatctcggtatttgccggagttgtgctgttttttaccaggatcaggcttccggaaattgtaaatcagaccttaagttctgtgggcagtatgatcggtccggcaagtatgatcgtaacggggatgctgatcgcagagatgaatctgaagagtatatttgaaaatgtgaaagtgtattttatttcatttctgagactggtcgtgatacctgtgatatcattgatgattttaaagataagcgggcttgtgaacatacattcggacggaaagaaattactgcttatcgtatttcttgcggtgattacaccgtctgcttcaacgatcacacagatgtgtcaggtgtatggaaatgattcgaaatatgccagtgcgatcaatgttatgacgacattgttatccattgtgacaatgccgctcatggtgctcttgtatcagactgtgatgtagaagagagtatagatgaaaggcgtgtatttgtatatagttgatgaagaaaattatctgttttctgattgaaagcgaaccaaaggtaagatacaatggagatatgaaggaggggagcagaagatggcagaattacttacagcggcgacaccgatatcctattatctcgttgcagtaaatattattgcatttattttatatggaacggataaagcgaaagcaatgcatcatcagtggaggatcaaagaggcagtgctgatagggattgcgtttgttggcggtgcatttggtgcgtttgcaggaatgattgtatttcatcataagacaagaaagatgaaattccgaatcttagttccaatcgctattatcatctggctgacccttggcggatttttggcagaacgtgatgtggtaggactgacgaagacagaccggccaaagaatgaatacaacggcacagagatcacaccgtatcatagcagtgtggataaagatggtgacggtacggatgatcagaccgatattttgaagaatgcattggtttatgtgaagaagcggccggtttacaagagcagatattatcagaccggttatccggatgacagatatggtgtctgtacagatgttgtcggatatgcgcttaagaaaagcggatatgacctgcgggaactggtagacgaagatatcagaaagaattcgaaggattatgatatcgatgagccggataaaaatattgatttccgaagagtaaagaatctgagaatatattttgaacatacagcgaccagtctgaccacggatgtaaatgacattgaacaatggcagggcggcgacattgtagtgttcaagaatcatatcggggtaatttctgacagacggaatgtggaaggtgtaccatatgtgattcatcataatgatccgtatcagaagaattatgaagaagatatcctacaggagagaacggatattgtcggtcatttcagaatatcgtaatggcaaagcactgtgaaatattaccaaatttcgcagtgcttttttggcgcatttttcaatatgtctttttatgacaaatcttttaataataaagactgttcgtctggtttagcattctcagcaattacatcacggacgttctgcatacgcatatccaggtcggcactgatctgtgcacaggcaagcatctcatcctccagatattttgctttgtcagccgggatatctttcttgtaacgcagcttatgttccagacttgcccaaaaatccatagcgatcgtacgaagctgtacttctacagtcatgttacgttttccgtcctgtaaaaagattggtacactgacaatcagatgaaggctgcggtatccgcccggttttggatttttgatatagtctttcttctcaagaagtgtgatgtcatcctgagaaagtaaacagtccgcaagcatgtagatatcatccggaaaagagcagatgacacggacgccggcaatatcatggatattttcttcaatagaagaaagggtgagaggtatgtcttttttacggatctttttaatcaggctttccatggatttgacgcgggacttgatatcctcgatcggattgcggtcatattccagggaatactgttcgtttaatactttgaatttcgtctctacttccatgatggcacattgataataggacatctgtttttctattggtttcatatttttattaacaaaatccagaaattcgtcagacatcagactgtttctgacgaagcgttctttgcgttgttcgataaatgtctcaaggggtctcatgttgcatttctcctttcattatccaaaaatattttagcatatctgtagttgaaattctatcaacagataggtgtgtttatgggagaatgcgacaatgtaaaagaattgtagcaagttgtacaaaatcaagtccaattgtcggatatattcacagttaaaatttttcgtggtaagataaatgacataacgtaagatataaagaaataaatcataaggaagtgtaagtttatgaattccagatacaaaggaatatttttcattacattatcggcgttatcatttgcattcatgaatgctttcgtaaggttatccggtgatctgccttcggtacagaagagctttttcagaaatctggtagctttttttattgcgctgatcatgatcataagaagtaaggacggatttaaaatcgaaaagggaaatctgaaatatatgattctgcgtgcgacattcggtacggtgggaatcttgtgtaatttctatgcggtggatcatctggtgctgtcggatgcatcgatgctgaataagatgtcgccgttttttgtaattatcttttcatttttattgctgaaagaaaagatgagtccggcacaggcactggcggttgcgggtgcattcatcggaagcttatttgtaatcaaaccgacatttacgaatatggcactggtaccgtcactgatcggactgtgcggcgggatctgcgcaggtattgcttatgcgatggtgcgaatcctggggaagagaggacagaaaggttcttcggttgtaatcttcttttcaggattctcgtgtgtggttacactgccatatctgcttttggattttcatccgatgagcggcctgcagatcttaacgcttctgggtgcgggacttgcggctgcaggcggccagttcggaatcacggcggcttattatcatgcaccggcgaaagagatatccatttatgattattcgcagatcatcttttcgacgattctgggcttctttctgttcggacaggtaccggataggtatagcgtgctgggatatgtgatcatatgtgcgatggcgctttggatgtttgtgtataataagaaccgtaacctttgtgtgtaaccggaaagttatagtaaaagttttaattttccggtgcttctatacacttctggtatcacaacggttacggtccggggatctggcttagtgaattaagtagaaaactgatttaataaaagataacgcgggaaagttttcttaataaattataagaaaaatctttcctgcttttcagattacgggtgtaaaatatagctcaaatacaaaaggaaaaatgaccatgatagaagaaatcctagaatacaacagaaaattcgtagaagaaaaagcataagagcttctaagactggtattacaaactgttattacattttacaataattatgttgacttatagaaaatccatgatatgattcaaatgttagatttaggaaatggtaattttatgaaggaaaacaaggggtaaaaaagatgaattataacaagattgtacaggggatcctggacatcggagaagcgatgcttcaaagtggtgcagagaatttccgtttggaagacagcttttaccgcatgtgcagaagctatggatttaagagatcggatgtatttgtcattccgagtaatatacaggtgacggtggagacaccggaaggcgagattattacacagatacgtcatatcgagtcgtcggagccgaattttgaccagctggattatctgaataatctgtgcagatatgtctgtcagcatacaccggatgaaaatgagatgcgtgagaagtatctggaagttatcaatcgtgaaccacagaagcgtatcacaagatatgcggcaggaatcatgggtggaacaggatttgctgtatttttcgggtgtaacctccgggatgcggtcattgcatttatagtatcggtgatgatcgttgcagtcggtgactggcttgcgaagcgtgaaagcaacttactggtttacaatggtattcttgcgtttatatcagaagtgattattatcggggctttgaagatgggaattgcagagcatccggaccgtattatgatcggtatcgtcatgcttctgatcagcggattgagtacaacgaacggaatcagggatcttcttcagagagacttcatttccggattcattaatattatgaattcgttccttggagcagcgggaattgcatttggaattggtctggcgatcatattattccatgagggatattccgatcattttatcctgaatcacagtgtaccgattcagctgctctcctgcacggttgcgtgtacgggatttgcattatggttcaagatccgtggaaaacaggtatggtataacagtatcggagcattttttacatgggcaatctatgttgcagtatacgcagtaaaaccgagtaacttcctggcaaccatgattgcagcaggatttgttggattttatgcatttatcatgtccagagtaaataaagcaccttcaaccatctttttgactgcatcggtattcccgctgatcccaggaccgaatctgtactatgtaatgtacgggtgtgtcagccaggatctgcagatggtttttgatgagacgattattcttctggcgacctgccttgcaattgcattcggatttatcatcgtagatgtggcatccagaagtatcatgcatgcaatgaagagagaatatcatatcggtaaaagcgcattgaatcttccgctgatcggtggaaagaaataataattgaaatctatgaattatgaaaagttagtacagggaatcctgaatataggagaagcaatgttacagtgcggggcggaaatcttccgggtagaagacagcctataccgtatgtataagagctatggtttcgtaaaatatgatgtatatgtgattccaagtaatatacaggtgacggtggagtcgctggaaggtgagattctcacacagatcaggcatatagagtctacaggggcggattacgacaggctgaattatctgaatgccctgtcaaggtatgtctgtgcatataatccggatgacaaagagctggtcaggcgttataaaaaagtaatggcacggccggatcagagtgaactgatcacaggaatcgcacagattacaggtggaacggcgtttaccgtattcttcggtggagatatgcaggatgcagttgttgcattgattgtctgcctgatgatcgttctggcaggcagatggcttggtaagcgggagggcaacccgatgatctacaatctgattcttgcattcttatcggaggttgtgatcatcagtgctgccaggatcggattgggagatcatccggaccgtatcatgataggaattatcatgctgttagtcagtgcacttggtgtgatcaatgggatacgtgatgtgatgcagagaaactttatatccggagcactggaagtaatgaattcaatgcttggtgcgtttggcattgcttccgggatcgcacttgcaatgctgttgatgggaaatatatcggcagaaggatttgatgtgaataaaaataccgtgattcagctgatttcctgtacgataggctgtatcggttatgcaagctggttcaaaatacggggaaagaaaatcctgtattccggtgtcggggcatttctgacatgggggatatatttactggtgtatgcatggtatccgaataatttttccgcaatagtagctgcgtcctgttttgttgcaggatatgcatttattatgtcgagaatcgatcatgcgccgtccacggtcttcctgaccgcatcggtctttccgttgatgccgggagcaaggctgtattatctgatgtatggtgtagtcagcagaaatttttcaatggcagcagaacatgcacgggtattgctcgaaacgtgtcttggtattgcatttggatttattattgtagatgtgatttcaagaagtatcatgcgggcgcagggaaaagaatatcacatggggaaaaagtctacagttattaaaaaagatgaaaaataaagactgtgttacgagcatccggatgatgcaggtgaattttccggattgacaattttccatccttataatatagtaaaaggcaaagagaagatctgatgactgacggataatgtggagtaccacagggaaatcagatacttggtagaagccgaccgtctgggcagcatttatcctaaatgggatgagtgttgtcctttttttacaacaccggatacagaagaaccggtagtgttgtatgaaaaggaccgggaattcagaaagacaacatacgatcaggaggaaatgaatgatgaaaacagatattgagatcgcacaggaatgtataatggagcctatcacaaaggtggcagaaaaagcaggaattccagaagaatatctggaacagtatggaaagtataaagcaaagattgattataattttttaaagaaatcagataaagaagacgggaagctgattcttgtgaccgcaatcaatccgacaccggcgggagagggtaagacaactaccacggtaggtcttgcagatgccctgcagagaatggggaaaaagcccatggtggcacttcgtgagccatctcttggacctgtattcggtatgaagggaggagctgcgggcggaggatacgcgcaggttgttccgatggaagatatcaaccttcattttacgggagattttcatgcgatcggagctgcgaataacttactggcagcaatgatcgataaccatatctatcagggaaatgacctgaatattgatccaagaaaaattgtatggaagagatgtgtggatatgaatgaccgtcagctccgtttcatcacagacggacttggcggaagggtaaatggtgtgccgagagaagacggctatgatatcactgttgcttctgaaatcatggcaatcctctgcctctcgaaggatattgcagatctgaaagaaagactcggaaagattattgttggttatacttatggcaagatcgcagaccaaaaaccggtaacagcacatgacctgcatgcagaaggtgcgatgtgcgcacttctgaaagatgctttgaaaccgaacctggtacagacactggagcatacacctgcaatcgtgcatggcggaccatttgccaatatcgcgcacggatgcaactcactgacggcgactagaatggcaatgaagcttgcagattatgcgatcacagaagcaggattcggagaagacttaggggcagagaaattcctggatatcaaatgccgtatggcaggaatcaaaccggatgcagtcgtgatcgtagcaactgtaagagctctcaagtataacggcggcgttgcaaaaccggatctgaatgaagaaaatctggaagcattagaaaatggaattccgaacttaatgaaacatgtggataatattaagaacgtatatggacttccatgtgttgttgcgatcaatgcgttcccgacagataccaaagcggaactggatcttgtagaggagaaatgtaaagaggtcggagtaaacgtggcactttccgaagtatgggcaaagggcggcgaaggcggtctgaagcttgcagaagaagtggtacgtttgtgtgaggaaccaggtgatttccactatgcatatgaactggaaggaacgatcgaagataaattggatcagatcgtgcagaagatctatggtggtaataaagcagtacttacggcagcagcccagaagcaggtaaaacagctgacggatcttggattcggcaacgcaccgatctgtatggcgaagacacagtacagtctgaccgatgatccgaagaaacttggagcaccgaaagactttgacattacagtccgcaacctgaaagtctctgcgggggcaggattcattgtagccctgacaggagacatcatgacgatgcctggtcttccgaaggttccggcagcagaaagaattgacgtggatgatgaaggaaggatcacaggattattctaagtgtagataaagttaacagtaaaatccggcggcttttgtgaggcctgccggattttttgacattttttgacataagatttacaggattttgaaaaacagcaggagaatatgtgctagaatttcaagttagtgttataatgcaagaagtaaaaaacggcaagcaggcatggctgcccggctgtgatttgaaaaggaggaatgcttatgcgtcaatgcccgaattgcaagtctgacaatccagatgatgcccgtttctgcaattattgtggaatgcgtcttcccgaatcaaaagaggaaacattatataatgatctggaaggactggaaaaagcccggaaggtagaattttccgatcaggagatagcagaggaatcggagaaagtaattgatgaagcgaagaaattattcgaaccagagtggagcgaagaaccggaagaaaatgatggtctgaaaaagcagctcacgattccggagaatctggatcatatgattgaagaagtgacgcgggaagaactggaacaggaacttcacaggaagatcaagctgagagaacaggatctgaaagagaatgaaactccggaagaagaaccggttgaagaaccgaccagaatgatcggagaggacagcaaagaagaggcagatgagccgacacgtatgttcacaggggatatcggagatttcattaagaagaaaaaggactatgaagatgttccggaagaagatgcatatgaagaaattcttcagtcctgggagagaaagcggaaagaaaagaagataaaacgggaaaaagaaggaaaagatccgagccgtgtgccgcaatttatccgggataaacgttcctggtcagatatgacaaccggacagaagaaagcaataaaaagaattgcagcagggatccttatggttgctgcattctgtattatagaagtatatcacggtcgcccggaggcggtggcagagcgctattgtaaggcgtacatgcaggaaaactggaagaaggcaggacgtctgtcagatcttccgaaaaacggatatgtaacgcaggatgaatatgtaagctatatgaagaaaaatgcggttactgggatttccggttatgaaataaaagagacaaaggaaaatcgtcagacagaggtagaatccggcggaaagcagcgtgcatttaccgttgcatataagacagaagataacaaagaaaagacgaagatgcttattgttcaaaaacagaaaaaacgaaactttcttttttttactgattggaaagtatcatcagacgagatagtagcaaatgactttaatctctatcttccggcaggttcaaaagcctggatcgatgatataaaactgacggaggattctaagctgaaagatgactctgacaatctggaacaatacaaagtgtcattgattgaaggggaacataagatcaaggtaaaagttccgtgcttccggatgtaccggtccgggtttcgggcgtcagataaaggaaatgcgacgatttctaagatgaagatatcggaaaatgggaaaaagaaatttaacagaaagatgcaggacatcctgaacgcatatgtgaaagctgcgaaggcaggcaaatctttctctgaagtagcaggattgtttgagaaggattcttcctgcaaaaaagagaacaaagaattctataatgacctgaagaagcagctcggttccggagacagttatataacgaaagaagtaaaacttgataattatgaaggaaaatatgtgatcagcggtgtaacaggagtggtcaggggaacgttgtcctatgattataaagttacttttaaagaagaaaataaaaatgagagccggtctgtgtcagagacaggtgatggcgaagaagatgcagacggaagttcgcagatgagtgccgaatttgtgtatcagaatggaagttatcagctgcgttccgttaatcccggaaatatctggtataagcagctacagtagatttattcccaaaaagttctttcaaaaaaatgcaaataatataggaaaaagcttgctttttaagcttggatatgatacgatattcgggcgaatggaagtaggctttttttttatgcctaaaatcgggcagcatcgcaagctgccacgaaacacgttaactaagaatataaagcgaggtggaagttgtgcgtacaagaatcacattggagtgtacagaatgcaagcagcgtaactacaacatgacaaaggataagaaatctcatccggaacgtatggaaaccaagaagtactgcagattctgtaagaaacacacattgcacaaagagacaaaataatcgccgcaagaaggagtgaatgtcgatgagtggtaagaaaactcagaaagaaagctggttcaaaggtctgaacagagagttcaagaagatcgtatggccagacaagatgacagttgcaaaagagacggcagcggttgtttctgtatccgtggtcctgggagcgattatcgcagttgtagattttttcgcccagtacggagtagatttattaattaaataactcaaaacggacaagaaaggtgagattatgtcagaggcaaaatggtacgtagttcatacctattcagggtacgagaacaaagtaaaagccaacattgataagacaatcgagaacagacatcttgaggatcagatccttgaagtaagagtaccgctggaagacgttgttgagatgaagaacggtgtccagaaagtatctcagaaaaagatgtttccaggctatgtgttgatacacatgattatgaacgatgatacatggtacgttgttcgtaatacaagaggtgtgacaggatttgtcggacctggatctaagccggtgccgcttacagatgcggagatggctcctctgggaatccagagagaggaagtagtcatggactacgaggagggcgacacagtccaggtaatcgctggagcatgggcagatacggttggtgtaatccagtctatcaacatgcagaagcagagccttactattaatgttgagctcttcggccgcgagaccccggttgaaattggtttcgcagaagttaagaaaatgtaacagtaagtgggaggggcgttgtatgttccccgccatcaccacaaggaggtaattgaaatggcaaaaaaagtagaaggttatattaaattacagatcccagccggcaaagctactccggcaccaccggttggacctgctcttggtcagcacggtgtaaacatcgttgaatttacaaaacagttcaacgctaagactgcagatcagggagatatgatcatccctgtagttatcacagtttacaatgacagaagtttcagcttcatcacaaagacaccaccggcagcagttctgatcaaaaaggcctgcaacatcaaatctggttcaggtgtacctaacaaaacaaaagttgctacaatcacaaaagctcaggttgaggaaatcgctaagacaaagatgccagacctgaatgctgctacaatcgagagcgctatgagcatggtagaaggtacatgccgttctatgggtgtaactgtaacagaataattgatgaagattaatgtgggagggttatcccgacaataccactaggaggtttatagaatgaaaagaggaaagaaatacgttgaagctgcgaaaacaatcgacagaggaacactctacgatgtagcagacgcagtatcattagttaaaaagactgcaacagcaaaattcgatgagacaattgaagctcatatcagaactggatgtgacggacgtcacgctgaccagcagattcgtggagcagttgttctgccacacggaactggtaaaaaggttcgtattcttgtatttgcgaaagatgccaaagctgaagaagctaaagcagccggagcagatttcgtaggtggagaagaacttattcctaagatccagaatgaaaactggtttgaattcgatgtagtagtagctacaccagacatgatgggtgttgttggacgtctcggacgtgtacttggacctaagggattaatgccgaatccgaaggctggtacagtaacaatggacgttacaaaagctatccaggaaatcaaagctggtaagatcgagtacagacttgataagacaaacattatccatgtgccagtaggtaaagcaagctttactgaagaacagcttacagacaacttccagacgcttattgatgcgattaacaaagtaagacctgcagcagttaagggacagtaccttaagagcgtaacacttacttcaacaatgggacctggtgtaaaaatcaacccaatgaagcttgtttaatccgcaagataataatgaataaaaactccgtatacagatgtgatgctgtatacggagtttttttataccaaagtttttttgtaaaagaaaatgaaaaatctcttgacaataacacacgcatatgataatatactacaggactgccgaagacagtaggtgcttgaaagagcgtaagaacacattttatgcggacgcctaccgaggaaagatcgatactaaagtatgacttatcaacctctatgtctttggatatagaggttttttacatttatatctgtcggcggtgtaaacttacaaatctacaaggaggtgcaccattcgtggcaaaagttgaattaaaacaaccagttgtacaggctattgcagaggacgtgaaagacgcaacaagcgttgtccttgttgactaccgtggactgactgttgcagaagatacagagatgcgtaaacagttaagagaagcaggcgttgtctacaaagtttgtaagaacacaatgatgaagagagcttttgaaggaactgatttcgcagcattagatgagcacttagaaggaccaagtgctatcgctatttctaaagatgatgcaacagctccggcaagaatcctttgcaaatttgcaaagaatgcaaaagcccttgaattaaaagcaggtgtggttgaaggaacattatatgatgcagacgcattaaatgaacttgctaagattccttcaagagaagagcttctttccaaattacttggaagcttacagtcacctatcacaaacctggcccgcgttctcaatcagatcgcagaaaaaggtggagcagatgcttgtgaagcagctccggcagcagaagaagctgcagaggcaccagcagctgaataggctgatggcagcgtaataatttatttcaaaaaaagaaaataagaaaaatggaggaaaataaaatggcaaagttaacaacagaagaatttattgaagctatcaaagagttatctgtattagagttaaatgatcttgtaaaagcttgtgaagaagaatttggtgtatccgcagcagcaggtgttgtagttgcagcagctggagcagaaggtggagcagcagcagaagagaaagatgagttcgatgtagaattagtttccgcaggagcagctaaggttaaagttatcaaagttgttcgtgaagtaacaggacttggactgaaagaagctaaagcattagttgacgaagctccaaaggtaatcaaagaaggcgcttctaaagctgaggctgaagaaatcaagactaaacttgaagcagaaggtgctgaagttaaccttaaataattcgagtttgattgaattatcagggcattccggtgacgggatgccctttcgtattataagggatgctgaatataagaaagaactgaaaaaatagtgcggatttgcttgacatacttgacaggcctgtgctatagtaaaaaatgcgctattgtggatagttatgccatgatttcgtaaaaaaaacaataaattgtgttgttttttgagactctgcaagttatatgggcagtgaaaagcccagccagaaaaataaatgaggagtgaaacgtcaatatggagaaaaacagaattcgtcctattaaaagtggaaaaagttcacgaatgagttatgcccgacagaaagaagtcgttcagatgcctaacttgatcgaagttcagacagattcttacaagtggtttctggatgaagggttaaatgaagtgttcgatgacatttccccaattacagattacagtggaaaattaagcttggatttcgtggattttactttgtgtgagaatgaagtgaaatacacgattgatgagtgtaaagaacgtgatgcaacatatgctgcacctctgaaagtcaaagtaagacttcacaataaagagacagatgagatcaatgagcatgagatctttatgggagatcttccactgatgacaagaacaggtacctttgtgatcaatggtgcggaacgtgtaattgtcagccagttagttcgttctcctggtatctattatgccattgcacatgacaaattaggtaaaaaactgtattcagctaccgtaatcccgaaccgtggtgcatggctggagtatgagacggattctaatgacgttttctatgtacgtgtagatagaacaagaaaggtaccgatcactgtgttgattcgtgcattgggaatcggtacaaatccggagatcatcgaactcttcggagaagagccgaagatcctggcaagttttgagaaagatgctgcaacgaattatcaggaaggacttctggaattatataagaagatccgtccgggtgaacctttggcagtagacagtgctgaaagtctgatcacaagtatgttctttgatccgagacgttatgatcttgcaaaagtaggacgttacaagttcaataagaagcttgcgttaaagaaccgtatcagtggtcaggtgctggcagaagatgttgcaagcccaatgacaggggaagttctggcagaagcaggaaccaagatcacaagagaactggcttctgcaatccagaacaatgcagttccatatgtatggatcagcgtagaagagacagaacgaccgatcaaggtactttcaaatatgatggttgaccttgatgctgttgttgatgtggatccggaagaagtaggggttacagagcaggtatattatcctgtgcttgctggaattctggaagagacagccggagacattgatgaattaaaggatgcgatcaagagagatattcacgatctgattccaaagcatatcacaaaagaagatatcttagcttctattaactataatatgcatctggaatatggcatcggaacagatgatgatatcgaccacctgggtaacagacgtatccgttctgtaggagagctgcttcagaatcagtacagaatcggtctttcccgtctggaaagagtggttcgtgaaagaatgacaacacaggatatggagggcatttctccacagtccctgatcaatatcaagcctgtaacagcagcagtgaaagaattcttcggatcttcccagctgtcacagttcatggatcagaacaatccgcttggtgagctgactcataagagacgtctttcagcgttaggacctggtggtctgtcaagagaccgtgcaggattcgaggtacgagatgtacactattctcactacggaagaatgtgtccggtagagacacctgaaggaccgaacatcggtctgatcaactctcttgcaagttatgcaagaattaatgagtatggatttatcgaggctccataccgtaagatcaaccatgatgatccgactaatccggtagtaacagatgaagttgtatacatgacagcggatgaagaagataattatcatgtagcacaggcgaacgagcagttggacgaagaaggacattttgtacgtaaaaatgtatctggtcgttaccgtgaagagacacaggaatatgaaagaagaatgttcgattatatggacgtatctcctaagatggtattctctgtggctacagctttaatcccattccttcagaatgatgatgcgaaccgtgccctgatgggatcaaacatgcagcgtcaggcagtaccgctcctgtttaccgaggctccggcagtaggaacaggtatggaagaaaaagctgccgttgactccggtgtatgtgtggtcgctgaagaaggcggtacagtagaacgttctacttctacagagattacagttcgtcaggatgacggaaaactgaaaaaatataaattaacaaaattccagagaagtaaccagagcaactgttataaccagagaccaatcgtcttcaaaggagacagagtcgaaaaaggcgaggttattgcagatggaccatctacatctaatggtgaacttggacttggaaagaacccgctgatcggattcatgacatgggaaggttacaactacgaggatgctgttctgcttagtgaaagactggtgcaggatgatgtatatacttctattcatattgaagaatatgaagcagaagcacgtgatacaaagcttggaccagaagagatcacacgcgacattccaggtgttggtgatgatgcactgaagaatctggatgaaagaggaatcatccgtgtcggagcagaagtccgtgctggagatatcctggtaggtaaggttactcctaaaggagagacagagcttacagctgaagaaagactgcttcgtgcaatcttcggtgagaaagcccgtgaagtaagagatacttctcttaaagtacctcacggagaatatggtattgtagtggatgcaaaggtatttacaagagagaatggtgatgagatgtcacctggagtaaaccagtcagtccgtatctatattgcacagaagagaaaaatctctgtcggtgacaagatggccggacgtcatggtaataagggtgtcgtttcccgtgtacttccggttgaagacatgccattcctgccgaatggacgtccactggatatcgtgctgaatccactgggtgtaccatcacgtatgaacatcggtcaggtcctggagattcacctgtccctggctgcaaaagcacttggattcaacatcgcaactcctgtatttgacggagcgaacgagattgatattatggatactcttgatctggcaaatgattatgtcaacttaagctgggaagagtttgaagcaaaacataaagaagaacttcttccggaagtactgcagtatctgtcagacaacagagaacacagaaaactctggaaaggtgttccgctttcaagagatggtaaggtccgcctgcgtgacggacgtacgggtgagtacttcgacagcccggtaaccatcggacacatgcattacctgaaactgcaccacctggtagacgacaagatccatgcacgttctacaggtccttactcactggttacacagcagccattaggaggaaaggctcagttcggtggacagcgtttcggagaaatggaggtatgggcactggaggcttatggtgcatcatacacactgcaggaaatcttgactgtgaagtcagatgatgtcatcggacgtgtgaagacttacgaagcaatcatcaagggtgagaatattcctgaaccgggaattccggaatccttcaaggtattgctcaaagagttacagtcactcggactggacgtacgtgtcttacgtgatgacaatacagaagtggagattatggaaacttccgatatgggagagacagatttccgttctctgatcgagggagacagaagatatcgtaatgatgatgacgaagactttggtaaacacggatacagcaaacaggaattccagggtgaagagctggttgatgtagaagaagaaccagaatcagacgatgatttcgatatgaattttgaagaaaatgatgactatgatttcggcgattcatctgatgatgaataggaaggggtccaaagtatgccagaaaataataaggaacaaacttatcagccaatgacttttgatgcgatcaagatcggtttggcatcacctgaaaagattctggaatggtcaaaaggagaagttaccaaaccagagaccatcaactatagaactttaaaacctgaaaaagacggactgttctgcgaaaagattttcggaccaagcaaggactgggaatgccattgtggaaagtacaaaaagatccgctataaaggtgtggtctgcgaccgttgtggtgttgaagtaacaaaagcaagtgtacgtcgtgagcgcatgggccatatcgcccttgctgctcctgtatcgcacatctggtacttcaagggaattccaagccgtatgggactgattcttgatctgtccccgagaacattggaaaaagtactgtatttcgcttcttatatcgtactggataaaggtgagtcagatctgatgtacaaacaggtattatcagaggctgaatatcaggaagcaagagaaaaatggggaagcacattccgtgtaggaatgggtgcagaatccatcaaagaacttcttgagaacattgatcttgagaaagaatatacagaattgacagaaggcttgaaaggtgcaaccggacagaaacgagcaagaatcgtaaaacgtctggaagtagtagaagctttccgtgagtctggaaacaagccagaatggatgatcatgacaaatatcccggttatcccaccggatcttcgtccaatggtacagctggatggcggacgttttgcgacatctgacctgaatgatctgtacagaagaatcatcaacagaaataaccgtctgagacgtcttcttgaattgggcgcaccggacattattgttagaaatgaaaagagaatgcttcaggaagctgtagatgccctgattgacaatggccgtcgtggacgtccggtaacaggacctggtaaccgtgcactgaaatctctttccgatatgctgaaaggtaagtccggacgtttccgtcagaacttgcttggtaagcgtgttgactattccggacgttccgttatcgttgtaggaccggaacttaagatctatcagtgtggtctgccgaaagaaatggcaatcgagctgttcaaaccatttgttatgaaagaactggttcagaacggaacagcacacaatattaaaaatgctaagaagatggtagaaagacttcagccggaagtatgggatgttctggaagaagtaatcaaagagcatccggttatgctgaaccgtgcccctacactgcacagacttggtattcaggcatttgaaccgattcttgtagaaggtaaggctatcaagcttcatccactggtttgtacagcgttcaacgccgatttcgacggagaccagatggctgtccatcttccactttccgtagaagcacaggcagagtgccgtttcttacttctgtcaccgaacaacttactgaagccgtctgatggtggtccggtagccgttccttcacaggatatggtacttggtatctattatctgactcaggagcgtcctggtgccaagggagaaggcatgatcttcaagagcttcaacgaagcacttcttgcttatgaaaatgctgccgtaacacttcattcacgtgtaaaagtacgtgtatccaagaagatggcagatggaacagtgaagacaggaacggtagaatctacagtcggacgtttcatgtttaatgagatcattccacaggatctgggatttgtagaccgtgaagtagaaggaaatgaattgcttctggaagttgatttccatgtaggaaagaaacagctgaaacagattcttgaaaaagttatcaatacacatggagctactgctacagcagaagtactcgaccatgtaaaggctatgggttacaagctttcaacaagagctgccatgaccgtatccatttctgacatgacggtacctccgcagaaaccggagatgatcaaaaatgcgcaggatactgtagataagattacaaagaacttcaaacgtggtctcattacagaagaagaaagatataaagaagttgtagagacatggaaagcaactgacgatgcccttacaaaggcgctgcttgacggtcttgataaatataacaacattttcatgatggcagattccggagcccgtggatctgacaaacagatcaaacagcttgcaggtatgcgtggtctgatggccgatacaacaggtcacacgatcgagctgccaattaaatcaaacttccgtgaaggtcttgatgtactggaatacttcatgtctgcacatggagctcgaaaaggtatgtccgatacagctcttcgtacagccgattcgggatatctgacaagacgtctggtagacgtatcacaggaactgatcatccacgaagtagactgtgcaaaaccgggagcaccgattcctggaatgtatgtaaaagcattcatggatggaaacgaagtgatcgaaagtctgcaggatcgtatcacaggacgttatatctgtgagaacatcgtagataaagatggtaacatccttgtaaaggcaaatcacatggtaacaccgaaacgtgcagagctgatctgtaaaaagggtgttgacgagaagggcgagccgctgacacagattaagatccgtacaatccttacatgccgttcacatagtggtgtatgtgcaaaatgttacggatccaacatggcaacaggcgagccggtacaggttggagaagctgtcggaatcatcgccgcacagtcaatcggagaacctggtacacagcttactatgagaacattccatagtggtggtgtagccggtggagatatcacacagggtcttcctcgtgtcgaggagcttttcgaggcaagaaagcctaagggacttgcaattatcacagaaatcgcaggaactgctaacttaaatgacacgaagaagaaacgtgagattattgtgacaaataaagaaacaggtgaatccaaagcatatctgatcccttatggatcacgtatcaaggtggctgacggcgcagaactggaagccggtgatgaactgacagaaggtagtgtaaatccacacgatattctgagaatcaaaggacttcgtgctgtacaggattacatgatccaggaagttcagagagtatatcgtctgcagggtgtagaaatcaacgataagcatatcgaggttatcgttcgtcagatgctgaagaagatacgtatcgaagagtccggagacacagaattccttccgggaacaaatgttgacagacttgagtttgaggatgtaaatgaagctttggaagcagaaggtaaagaacctgcaacaggtgagcagatcatcatgggtattacaaaagcttcccttgctacgaattcattcctgtctgccgcttccttccaggagacaacaaaagtcctgaccgaagctgctattaagggtaaggttgatccgctggtaggtttgaaagagaatgttatcattggtaaacatattcctgccggaacaggtatgagaaagtatcgtgacatcaagttgaacacagagatggaaatggaagacgaactggattttgaggacgattttgattttgaattcaaagatgcagatgagatgaatcaggagattactcttgatgaaggaacagaagatgcagtagaagatattgcagaagaaacagttgctgtatctgaagatgaagaataaaatataagtcaaataaaaagaaagtgttcacactgaaaagtgtggacattttcttttttttaatgaagaataagttaatatcactaacgtttactgttatttgtatatataaattgacttttatattcaaaaagtttataataattgtcagtgagaatcagcgaaaatagtaacagattctgtcaacattttaagaaaggttggggttctattatggatcaaggtaaacttacaagaatattaaaatcaatggaggagcatgaggttccgcagatgatcgtttctgacccggttgcgatcttctatctgacaggcaagtggattttcccgggagaaagacttctggcattgtatctgaatgtgaacggaaatcataaaatggtaatcaacaaattatttccacaggaatcagatcttggcgtagatattatctattatgatgacattgaagacggagtagagatcttaagcaagtatgtagataaagataagacaatgggaattgataaaacatggccgtcaaaattccttattcgtctgcaggagttaggcggaggaagtaaatttgtaaatggatctccgatcatcgattatatccgtatggtaaaagatgagaaagaaaaagatcttatgagaaaatcttctaagttaaatgatattgctatggaaaagatcattccatgggtagcaaaaggattaactgagaaagaattaaatgcaaaaatgcgtgaaatttacaaagaaatcggatgtgaagatgtatcgttcgatccaattacagcatacggacatggcgctgcagatccacatcatgtaacagatgattccaaaggaaaacgcggagattgtgtaattcttgatatcggtggatttaaagataactatgcatcggatatgacaagaactgtattcatcggtgaagtatctgaccgtgcaaaagaaatttatgatatcgtagttgaagcaaacagaagaggtatcgaagctgccaaaccgggaaatagaatgtgcgacgttgaccttgctgcaagaaattacatcgaggaaaaaggatttggcgagtatttcacacacagaacaggacattctatcggactggaagatcacgaatttggtgatgtatcatctgttaatactgacatcatcaaggttggacagtgcttctcagtagagccgggaatctatctcccggatgagaacatcggtgttcgtatcgaagaccttgtaatcatcacagaagatggatgtgaagttctgaatgactttacaaaagacctgatcgttgtaccggaagagtaaaatatcagaatacatatttcgtacagaaatggagaaaatgcagatgacaagagatcaggcgtatgaaatcttaacaaaatacatgaaaggtgagaattatattacacattctctggcagttgaggctattatgaagggattggctaaacgtcttgcgccggacgaggtggaatattggggaattgcaggattgctgcatgatctggatgaagagcaatgtgactgggagcatgacttaagtgtacacggaccgacatcggtagaaatcttaaaaaaagaagggattgatgatcctgtattatttggagcgatctgtgcacataatccgaaaagtggcgtgaaagcgaaaacaaaaatccaatatgcacttctggctgcagatccaatgagtggtttcttaaaagcggttgcgcagatttacccggataaaaagattgcaagtgtaaaaagaaagtctgttataaaacgttttaatgaagcacgatttgcgaaaggtgccaatcgtgattacatggaaagtattgaatttacagggctgatgctggaagatctgattgatatcggattggaagaaatgtgtgcgatctctgatgaattaggattataacaaagtataaaatggtgttgtaagaaatatagatcttacaacaccatttataatatatcactaattattcataacgctcatcgatgacacgttttgtcttcttttcgcttcgaggtaataatccgatttcaacaactttaactaacggtgtaaagcctatgcggcttttgacggtagctgcgattcgtttggcaagatcaaggaagtcaaccgttccatttgtttcaacatagattcgcatggtgtcttttccgtcaagatgagaaatgcggatctgatattcactggatacttcagaaaattcttttaagatttcctcaatctgagctgggaacacatttacacccttgatcttcatcatatcatcggtacgtcccataatagtatcgagccgtgggaatctgcttccgcaaggacattctcccggaatgatgcgggaaagatcatgtgtgcggtagcggataagaggtgctccttctttgaccagggtggtaatgacgatttctccgagttctccgtctggaagtacttcaccggttacagggtcgatgatctcaatgtaaatataatcatcccagtagtgcataccacagtcatgggaacagctgattccgattcccggtccatagatttccgtcaggccatagatatcatagagttcaattccaagttcttccgtgatacgccggcgcattttttcaccccagcgttcagaaccaatgattcctttcttcagatggatcttgtctttgattcctcttttttggatttcttctgcaagaagcagggcgtaagaggaagtagaaccgagaacggttgtcttcatatccatcatcatctgaagctgtttgtcggtgtttccgggtcccataggaataaccatgcttcctaatctttcggcacctgcctgaaatccgattccggcagtccagagtccgtatccgggtgtgatctggatacggtccagatttgtaagaccggccaattcatagcagcgttgaaacatgattgcccagtcgtctacatctttctgagtatatggaatgatgaccggcagtccggtggtaccggaagaagagtggattcggacaatcttttcttccggtgcggtcatcagaccaagaggataagcatttcttaaatcatttttctcagaaaacggaagcttttgaaaatcttccgctgactgtatactggtaacaccggcttcttctaatttctttccatagaaactttctgctttcaggagcgcctgtatctgattatttacctgtgcgatttgtgtctctgtaatctgcatatgtcgtgttcctgcctttctttgttatatgttatagtttaatgcccggagattcatttcatggaatttctcgggaagtgtatatttcataatgtcttcaatttcagagattgtaaagtccagtactccggtccgtatggctgcgccaagaagcaccatgttcagtactttggaagaaccaatgtctgcacatgcctgatctgcatttacaagagtcagattaggaacagccgcttttagatattcaagcatctgaggtgcatcataatctgatccgcttaaggtagcagtaactggttttacagctcgggtgctgacaacaatatgtccgtggtctttgagatagggaagcatacggactgtctcacctggttcgaagccgatgatcaggtcggcagttcctgtttcaatcattggcgaatagagattatcacccatacgaagatgactgaatacactaccaccacgctgagccataccgatggtctcggcactcatgacaggaatatctttactcatagctgctgcggcaagaagtttggaagcgaggacggttccctgaccgccgacgccgcacaggacaatgtttttttgattattcatgttttttacctcctataatagcagctgcagggcatacctgactgcataatccgcagccggtacacatcgtatcatcaatgcagacattaccgttgtcaagtacaatggcagggcatccaagttcacggatacattttttacatccgatacatttttcggcatctatatgaagagaaaacgccggcttggtgatggctatacatggtgatttgaatataatagcttttacacctgtcttatcagccatttcccggacgcatgctacagatgagttcagatccagcggatttacagtcttaacatctgtaacgccgattccgcggaggacttgttcgatattaatcttttgcacgatctcccccatcactgtgcggccggttccagggtgtggctgatgtccggtcatggctgtggtagagttgtctagaacgatcaggatcatattcgcctgattgtacacggcattgacaacacctgtgatcgcagaggcgaagaaggtcgagtctccgacaaacgcaaagcatgtggtgtcaggttccactttttcgataccttgtgcaatattcaatccggcacccatacacagacaggtatcaaccatatcgagaggaagggcatttccgagcgtataacatccgatatccccgcagaaaacggttttctttcctttcatagctttttttacggcgtagaaagaagctctgtgaggacatccggcgcaaagtaccggcgggcggaccggcagtgccggcggttccggaaaatcagtggtgacaggggaggtaagaccaagaaatgtattaatataggtagttatagtgtcacgagtgttttctccggcacaggcagtatgaccactgagttttccgttaattctggttggaagatgatattttccgcatatatagatcagctcacgttcgatgaccggatcaagttcttccaggcagagaacttcatcaagtccagaaaggaaatctactgctaatttttccggaaatggatgaggcgtggcaatttttaaagtctttaccataccggtcttttttaatgtttccatcgtgtaggtatagctgatccctccggtggcgattcctttttttgaatccttgaaagcatcgcaggatggatgaatcgtatttttctcataagaagaaaagatatcggataattcctggttacgtgcttcgatttttttgtgattcatgaaagataatctaggaaagataacccagcgtttagaatctttgataaaaccttccggctggtggtgggtatattctgtctcatcttttaccatgatagacgcgtagccatgacagacacgtgtggttggacgtaagaataccggagtaccgtatttttctgaatattcaaaagcttcctggatcatctcataagcttcctgtgccgaagatgggtcaaagcaaggcagcttggaaaatctggaaaaatgtctagtatcctgctctgtctgagaagaaatcggacccggatcatctgctacgagaatgaccattccgcctttgatcccgacgtactcgagactcatcagcggatcggaagcaacatttaatccgacttgcttcatggttaccatggatcttgcaccggcataagaagctccggcagccagttccatggcagctttttcgttcacggaccattccacatacacatcatccggccggtgttttgctatagtttccagaacttccgtagaaggggttccgggataaccggctacgacattaactccggcagcaactgcaccgagggcaattgctgcatttcccattaaaaattctttatgcataatcatatcacctctaattgtacgaattcgttattaaaatagtataatatgtctgataaagaaatgcaaccttttggtaacgtgataaagtggaataaagcaaaggaaacgaagaatgtcttttcggaaatacaaggatatgatagaataactctaccagatagattgtgacaggtatcagaaaataaaaagaggtatgtaagatgaaaaaatatgattatttagtagtcgggtcaggattatatggggcagtgtttgcccgtgaagcaaaaaaagcggggaaatctgttctggtaattgataaacgtccgaatatcgcgggaaatgtatatacagaggatgtagaaaaaattcatgtacataagtatggtgcacatatttttcatacaaataataagaaagtatggaattatatcacgcagtttgcggagtttaacagatttacgaattcaccggtagcgaattataagggtgagttatattcacttccttttaatatgtatacatttaacaagatgtggggagtggtgacaccggaagaagcagaagcgaagatagaagagcagagaaaggaaattacgggagagccaaagaatctggaagaacaggcagtttcactggttggaagagatatctatgagaaattgatcaagggttatacagagaagcagtggggacgtgactgcacagaacttccggcatttattatcaagagacttccggtgcgtctgacattcgacaataattatttcaatgcaatgtatcagggaattcctgtgggagggtacacgaagatggtagagaatcttctggatggcatagagatccgtctgaacacagaatatctggagcataaagaggaattagatgcgctggcagaaaaagtagtttatacaggaccgatagatgcttattttgaatataaactcggaacgttggagtaccgctctgtaagatttgagacggaacttttagacaagccgaatttccaggggaatgcagctgtaaactacacagacagagagacgccttggacacgtatcatcgagcataagtggttcgaatttggaaaggattcagaaggaaatgatattccaaagactgtgatcagccgggaatacagctctgaatggaaattgggtgacgaaccatattatccggtcaatgatgaaaaaaatggagcattgtacgcagaatacaaaaaattagcagaaaaagaagagaaagtgatcttcggaggccgtctcggggaatataaatattatgatatggatgctgtcatagcatcagcgttagaactctgtgaaaaggaactcggaattataaccggataataatgaaaaaagtatgcatagaagcaattgtctttgcacatatgcatacttttttgccatttttgcttgaacttgagtctaataccaactataatgggggcagttgctttgtgaaagatagacgatatattattttaggagaatagatatgggaagatatttcggaacagatggtttccgtggcgaagccaataataacttaacagcagatcatgcatataaaatcggaagatttctcggatggtactatggagaaataaaacgtcagaatggtgatgatacacccgcacgtattgtaattggaaaggatacgagacgttccagctacatgttcgaatatacattggtaggtggacttgttgcatcgggagcagatgcttacctgcttcatgttacaacaacaccatctgttgcttatgtggcaagaacggatgaatttgattgcgggatcatgatctctgcaagtcataatccgtattatgacaacggaatcaaactgatcaacggtaatggcgagaagatggatgagggaacgatcgcactggtagaagactatctggatggcaaactggaagtatttggggaaaagtatgaggagattccatttgcacatacatctaagatcggacgtacagtagactatgtatcaggaagaaaccgttacatcggatatctgatttcacttggactttattctttcaagggtgtgaaagtcggactggattgtgcgaacggaagttcatggaatctggcaaagtctgtatttgatgcacttggagccaagacatatgtgatcaatgcagagccggacggaacgaatatcaataacaatgcaggatctacgcacatcggcggcctgcagaaatttgttgccgagaatggtctggatgttggatttgcatatgacggagatgctgacagatgtctctgtgtagatgaaaaagggaatctgatagatggagatgcgattctttatatttatggaaaatatatgaaagaacgtggcaaactggaaaacaatacggttgttacaacagttatgtctaattttggattatacaaagcattcgatgaggcagggattgattatgcaaagactgcagtcggagacaaatatgtatacgaatatatgacaaacaatggatgcattctcggaggggaacagtccggtcatattattttctcaaaatatgcttccacaggagacggtatccttaccagtcttaagatgatggaagttatgatggcaagaaagaagaaaatgagtgaactcatggaaggacttcatatttatccacaggttctggagaatgtacgtgtgacagataagaaagcagcgcaggacgatgcggatgtacagagcgcggtacgggcagtaacagaagcccttggagataccggacgcatcctcgtgcgggaatccggaacagaaccacttctcagagttatggtagaagcagagacagaagagatctgtaaaaagtatgtagatcaggttgtagatgtagttaagaaaaaaggatatgtgatcggctaaagcagcggacctgaggcagagataagatacataaataccagaaatggaatagattatattaagaataatacagggagaaaaatcgaattatgtgtggaattgtaggatttacaggtgaacaccaggcagcaccgatcctgttggatggtttgtcaaaactggaatatcgtggttacgactcggcaggaattgctgtacgtgacggcagtgcagatgcagagatcattaaggcaaaaggcagactgaaagttctggctgagaagacgaatgatggtgaatccgtaaaaggaacctgcggtatcggtcatacaagatgggcaacacatggagaaccatctgagaataatgcacatcctcatgcaagtgatgatggaaatgttgtggctgttcataatggtattattgaaaactatcaggaattaaaggataaacttgtccgtaaagggtatacattctattctgagacagacacggaagtagcagtaaaactgatcgattattattataaaaaatacgaggggactccagtagatgcgatcaatcatgcgctggtacggatcagaggctcctacgcactggcaattatgttcagggattatccggaagaaatctacgtagcaagaaaggacagtccgatgatccttggagttgcgaacggagaatcctatattggttccgatgttcctgcaattctgaaatatacgagagatgtatactatatcggtaaccaggagatggcacgtgtccgtaaaggtgagattacattctataacctggatggagaagagattgaaaaagaattaaagacggttgaatgggacgcagaggcagcagaaaaatcaggatatgagcatttcatgatcaaggaaatacatgagcagccaaaggcagtttcagatacactgaattccgttataaaagacggaatgattgatctttcagaggtcggactttcggaagaagagatcaaagagatcagccagatttatatcgtggcatgtggatcggcatatcatgtcggagtggcagcacagtatgtcatggaagatatggcaagaattccggtacgtgtagaacttgcatcagaattccgctatcgtaatccgattcttgatccgaaaggactggtagtcattatcagccagtcaggagagaccgcagacagtctggcagcactcagagaatcaaagaaacagggagtaaagacacttggtatcgtgaatgtaatcggttcttctattgccagagaggcagacaatgtatactatacactggcaggaccggagattgcagttgcgacaacaaaagcatacagcacacagttgatcgcagcttatacacttgcaattcagtttgcaaagatcagaggacagattacagaagaacagtatgtcggatatattgaagaacttcagagcattccggagaaaattcaaagaattatcgaggataaagagagacttcagtggtttgcatccaaacaggtgaatgcgaaagacattttctttatcggtcgtggaattgattatgcgatttcccttgagggaagccttaagatgaaagaaatcagctatattcattcggaggcatatgcagcaggagaattgaagcacggaacgatttccctgattgaagatggtacactggttatcggagtactgacacagccggaattatatgaaaagacactgagcaacatggtagagtgtaagagccgtggcgcatatctgatgggacttacaacatttggacattataatattgaagaaaacgcagatttttctgtatacattccaaagacagaccctcattttgcaacatcacttgcagttattccgcttcagttacttggatattatgtatcagtagcaaaaggtctggatgtagataaaccgagaaaccttgcaaagagtgtaacagtagaatagaaatgaacagggtgggatatggcatgataaacagtcatggtatatcccgcttttttgtgctatactgattttaactgtaaaaaagacaaataaacaaaggagaaagagaattatgaaaacagcattagtcatcatggctgcaggaatgggttcgcgttttggtggcggaattaagcaactggaaccggtaggcccaaatggggagattattatggattattccattcatgatgcaatagaggccggatttaataaagtagtatttatcattcgtaaggatatcaaagatgcatttcatgatgcgatcggaaaaagaattgaaggaatctgtaatgaactgaacatagaatttgcttatgcatatcaggagttggatgatcttccgaaaggaattgaaaagccggccaagagaagcaagccgtggggaacaggacaggcggtactggtatgtaaagatattatcaaagagccgttcgtagttattaatgcagatgactattatggaaaagaagcatttgtaaagattcatgagttccttgtggaaaattatacaccggaaaaatcaaaagaactttgcatggccggattcattctcggcaatactttaagtgataatggaactgttacaagaggaatttgtgcagtagatgagaatgattatctgacagatgtcgtagaaacttatgaaatcaaaaagacatcagacggagcagaatctcagggaaatagaattgatgtaaatgcacatgtatcgatgaatatgtggggactgacaccggagtttgtaggacttctggaggaaggatttgtagaattctttgagaatatcaaaggggatgaagcaaaagaactgaaaggtgaatatctgctcccgatctatattgatgagcttctgaaaaagggaaaagtaagtgtcagacttctggagacacaggacaaatggtttggcgtaacttataaagaagacaaaccggttgtagtagagtcatttgcaaaactgatcgcagacggtgtatatcagaaagatctgtttgcagatcttaaggcgtaatatccgggatataaccgcaggtatgatatcaaaagcatgtgaatgaacaggaagaaaaagacaggaaagaatatggcgggaaacaggagaaagagaaataaggccggaatcatctggctgtttcttatgctgatctggctgatagtgattttttcattttcagcaaaaaaagcagatgaatcgacggtaatgagccactccgtcggaaagttgattggaaatatcgtgattccggagtacagatcctggccggaagataagcaggaacagtttgcggaaaagatagattttccggtacgcaaatgtgcgcatgcgtcggaatacgcagtccttggtgtgttgatgctggggactgcgtactcttttgcggaagatcggggaaaaaagaacagattattatgctggtgtgcaggtacggcgtacgcagcaacagatgaattccatcaactattcgtgcccgggcgcagctgtcagttcagggatgtctgtattgacagcgcaggcatactgacaggtatcgtgctgtttagcctgataaagcatcagatcgcgaaatataatgaaaagaaaaaagtggcaaaaaacgtgaaaaatcaagggaaatcccttgacaagaatcatgattcgtaataaactaaacaagcgtgcatgggaacgttttgttttgatgtacgactattcacaagatgaataagcaacttattataatcgtaggaggtgaaagaaatgccaacatttaaccagttagtaaaaaaaggacgtcagacatctgtaaagaagtctacagcaccagcacttcagaaaggatacaactctttaaagaagagaagtacgaatacttctgcaccacagaagagaggtgtttgtacagctgttaagactgctacacctaagaaacctaactcagctcttagaaagatcgccagagtacgtctgtctaacggaatcgaagtaacaagctatatcccgggagaaggacacaaccttcaggagcatagtgttgttctgatccgtggaggaagagtaaaagaccttccaggtacaagatatcatatcgtaagaggaacacttgatacagcaggtgttgctaagagaagacaggctcgttctaaatacggtgctaagagaccaaaagatgctaagaaataaatctattgcatagacaacagataagatttcaaaccaattaaaatgtaatcacaaacagaactatgattatgtaagttgcaaggtatatatatgtatgccctatgcactacacagtatcattagaaagacacatgtgagtaccgatgaattaaattaagatgtttaaggagggaaggaccgtgccacgtaaaggacatactcagaaaagagacgtattagcggatccagtatacaacaataaagtggtaaccaagcttgtcaacaacattatgcttgatggtaagaagggtgttgcacagaaaatcgtatacggagcgtttgaaagagttgaagcaaaagccgaaaagccagctatcgaagtatttgaagaggctatgaataacatcatgccagtacttgaggtaaaggctagacgtatcggaggagctaactaccaggtaccgatcgaggttagacctgagagaagacagactcttgcacttcgttggctgacagtatactctcgtgctagaggagagaaaacaatggaagaaagactggctaacgaaatcctggatgcagcaaacaatacaggcgcatctgtaaagaagaaagaagacatgcacaagatggcagaagcaaacaaagcatttgctcattatcgtttctaattataggaggaaaaaatcttggctggaagagaatatccattagagagaacaagaaatatcggtattatggcgcatatcgatgctggtaagacaactcttaccgagcgtatcctgtactataccggtgttaactataagattggagatactcacgaaggtactgctaccatggactggatggaacaggagcaggaaagaggtatcacaatcacttctgcggctacaacatgccactggacactcgaagagttcacaaaacctaaaaagggagctcttgagcaccgtatcaatatcattgatactccgggacacgttgactttactgtagaggttgagcgttcactccgtgtactggacggcgctgtcggcgtcttctgtgctaagggtggtgttgagcctcagtcagaaaacgtatggcgtcaggctgacacatacaatgtaccaagaatggcattcatcaataagatggatatcctgggtgctgatttctacaatgcagtagaccagattaagaccagacttggaaagaacgctatttgtcttcagttaccaatcggtaaagaagatgacttcaagggaatcattgacctgatggaaatgaaagcttacatctacaacgatgataagggagatgacatttctgttacagatatcccggaagatatggcagatgatgcagaactttaccatacagaaatggtagagaagatctgcgatcttgatgatgatctgatgatgcagtatctggaaggtgaagaaccatctgttgaagatatgaagaaagcactcagaaaagcaacatgcgagtgtacagcagttcctgtttgctgtggttcagcttacagaaacaaaggtgtacagaaacttcttgatgcaatccttgagtacatgcctgcaccaacagatatcccgccaatcgatggtgtggatgaggatggtaatgaggttgtaagacattcttcagatgaagagccgttctcagcacttgcattcaagattatgacagacccattcgtaggtaaactggcatacttcagagtttactctggtacaatgaactcaggttcttatgtactgaatgctacaaagaataaaaaagagcgtgttggacgtatccttcagatgcatgccaacaaacgtgaagagcttgataaagtatattcaggtgatatcgcagccgctatcggatttaaattcactacaacaggtgatacaatctgtgacgagcagcatcctgtaattctggaatcaatggaattcccagaaccagttatcgagcttgctatcgagcctaagacaaaagcttcccagggtaaacttggtgaatctcttgcaaaactggctgaagaagaccctacattccgtgctcatactgatcaggagactggacagacaatcatcgccggaatgggagaacttcatcttgaaatcatcgtagacagacttcttcgtgagttcaaggtagaagctaatgtaggtgctcctcaggttgcttacaaagaagcatttacaaaaccagttgatgtcgacagcaaatatgcaaaacagtcaggtggacgtggacagtacggacactgtaaagttaaattcgagccaatggatgttaacggtgaggaaacattcaaattcgaatcttctgtagttggtggagctattccgaaggaatacatcccggctgtaggtgaaggtatcgaagaggctatgcagtctggtatccttggaggattcccggttgttggtcttaaggctaatgtatatgacggttcttaccatgaagtcgattcaagtgaaatggctttccatattgcaggttctcttgcatttaaggacgctatgaagaaggcatctccggttcttcttgagcctatcatgagagttgaagttactatgccggaagagtacatgggtgatgttattggagacattaactcacgtcgtggacgtatcgaaggtatggatgacctcggtggtggaaagatcgttcgtggattcgttccattgtcagaaatgtttggatactctacagacttacgttctagaacacagggacgtggtaactactcaatgttcttcgagaaatacgagccagtaccgaagtctgtacaggagaagattttatccagcaaaaatgactaattatttataaaatgcttgaaaaagtgctacatttgaaatataatcaaatgtagccgagcaaacgaacaatttgttaatatgccatatggcactaaattaaggaggatattcaaaatggctaaagctaaatttgaaagaacaaaaccgcattgtaatatcggtactatcggtcacgttgaccacggtaaaacaactcttacagctgctatcacaaagacacttgcagcaagagtaccaggaaacacagcagagaactttgaagatatcgataaagctccagaagagagagaacgtggtatcacaatttctacagctcacgttgagtaccagacagagaaacgtcactatgcacacgttgactgcccaggacatgctgactacgtaaagaacatgattacaggagctgctcagatggatggagctatccttgttgtagctgctactgatggtgttatggctcagacaagagagcacatcctgctttctcgtcaggtaggtgttccttacatcgttgtattcatgaacaaatgtgatatggttgacgatgacgaacttcttgaattagtagaaatggaaatccgtgaactccttgacgagtatgaattcccaggagatgatactccaatcatccagggatcagctcttaaagctcttgaagatcctaattcagagtggggagacaagatcatggaactcatggatgctgtagattcttatatcccagatccagagcgtgatacagataagccattccttatgccagtagaggacgtattctctatcacaggacgtggtacagttgctacaggtagagtagagcgtggtgttcttcatgtatctgacgaagtagaaatcgttggtattcacgaagagactaagaagacagttgtaacaggtgttgaaatgttccgtaaacttcttgatgaagctcaggctggtgacaacatcggtgctcttcttcgtggtatccagagaacagaaatcgaaagaggacaggttctttgtaaaccaggttcagtaacatgccatcacaaattcacagctcaggtttacgttctgacaaaagatgaaggtggacgtcatactccattcttcaacaactatcgtccacagttctacttcagaacaacagacgttacaggtgtttgcgaacttccagaaggtgttgaaatgtgcatgcctggtgacaacgtagaaatgacaatcgaactgattcacccagttgctatggagcagggacttcgtttcgctatccgtgaaggtggacgtactgtaggatcaggacgtgttgctacaatcatcgagtaatcactgactaatatatattgagtaccgcaaggtacattgtgtccaaacgtaagataccccggaaccgtaaggtttccggggtttttctgtactctaagaaaagaattattcgtaaatttatcaggttagtaatagtgaaacatttatcagcaagatgaaatacagataaatttataattaaaaaataagaccagcggtgccaaaacggtgccaaaaagaaactcctgcgaatgtttgctattcacaggagtatttttttaccagcctttgatctgtttgatttgttcagcacgttctggatcacgatgatattgtaatttcagacggatagtttccacaacttcctgtctggattcatcatcaagctgatagaacgatgtaagcagattatctacatcaggcatactgttcttaccgaaaaggtacatcagcggatacatagaattttttaagtaagtctttacacgacttgcgtctaatgctccgttcaaaccgtctggaagtgtaggataaatctcttcttccttaattgtgccagaaaatggactggcagaacatatctcattcacatcaatttgcaattcattcgcaagtcttaatgcaaaatcaaatcgaatattggaatctttttgaataattgaatataaggttgtagcactgattccggttgcctttgcaattttgcggacatttgtgcctttttcatcaagatatttctttaaatttttaccgtcacccatagaatcctcctttttcatatattagaaaattacgaaaaacataaatctataaaatatcataacacagacgtggaataaaataaagaaaaaatagtgtacgaagttcgtaaaaatgtgtttacgaaatattgacaacgatagaaatacatgatattatcaatttacgaaaatcgtacagatatagaaatacagtaaacgtattctatatctggagaggaaaggaggaggcaatatggcaagttacaattatatgatgagtgctgatgaagtggcacaggaattaaactgctcaaaatctcatgcctataaactggtgaaagctatgaataaagaattatctgcacagggatatattacgatggctggaagaataccaaaggcgttttgggcaaaaaagatgtatggctatgaaatagcagaaaattagggaggatcaatatggcttacagagaaaaagacacaaaaaaatggacagcccagtggtttgagacaaatgtcatgggtgagaagaaaaaacgcagaaagcgtggatttgaaacaaagcgagaagcattggagtttgaacgaagcaaaaagttgagcaatgagcgaagtatggatatgaagctgagcgattttattgagatttatttttcagacaaacaaaatgatctgaaagatcgaacaatcaaaaataaaagatatatgatgcaacagcatatcgttccatacttcggaaatcagatgatgagtgaaatcaaggcttcacagattattcagtggcagaatgaaattcagaaaaaaggctattcagattcttatctgagaatgattcagaatcagttgaccagtctgtttacacatgcagctaaaatctatgacttgccggttaatccatgcaagaaagtgaaacgaatgggaaattcagattcaagaagtttgaacttctggacactggacgagtacaaacagtttatacagacaatggagccgggaacaagatattatcttatgtttgagatgctgttctggactggatgcaggatcggggagctgcttgcgattacaaaagctgatatcaattttgaaaagaatcagcttagtatcaataagacttattaccggacaggaatgcaggatattatcacagaaccgaaaacaaaacagtcctttcggacaatcgaaattccggaatttctgaaagaggaaattaaggaatttgtagatggtcattacggaatgccggatacagaaagattatttccggttgttcaggaagcggtacagcataagatgaaacggcagattgagctggcaggagtgaagaaaattcgagtgcatgatatcaggcacagccatgtggcttatcttattgagaaaggtgtggaaccgttattgattcgggacagattaggtcataaagatattcgtatcacattgaacacttatggacatctttatccaaatcagcagagaaagattgcaaatcttctggataatgaaaatggaaatgctgttaccggattgggagaagaaagagatgaatgttgaaaaggcaaaagaaaaagcccagataaataatctgagcaagttctctgataatcagattcactgatataccatcttggcagattcagtatatcacgaatcgggaaatacgacaattcccgaatatctgttcatcagagacttgcccggaagggcaggaggagatgatggaatgaatatgaatgaaaaaaataaaattgagaattgtagaatagaaccaaaactgaaactgatcaatatggattcagtagaggtggaacaggtagaatggctgctttatccgtttattccttatggaaaagtgaccattatacagggagatccaggagaaggcaagacaacgatggtacttcagattattgcaaaactgaccagaggagagccgattcttcctgttactgataaaacgaaaacaaaagaaaaacgaagtgatgaagtcgatagtgagaatgaagatttagatgctgaagataatatgcaggaacagtcttctgtgtcacctgtaaatgtaatctatcagacagcagaagatggacttggagatactatcaaacccagattacttgctgcaggtgcagattgttcaaaggtgctggtgattgatgacagtgaccagccactgacaatggcagatgtcagattggaagaagcaatcgtgcagacaaaagcaaaaatggttgttcttgatccgatacagggctttctgggagcggacgtagatatgcacagggcaaatgagatcagaccactgatgaagcgtatcgcagtgctgtcagaaaaatatcactgtgcagttattttaatcggtcatatgaacaaaaacagcaacggcaaatcttcttatcgaggacttggctccattgattttcaggctgctgcaagaagtgttctgattgtcgggcgagtgaaagatgaaccggaagtaagagtggtatgtcatacgaagagttctcttgcaccggaaggaacgtccattgcattcagactggataagaataatgggtttgaatggattggagaatatgatatcagtgccgatgaacttcttaatggagacggaagaggacagaaaagtcggaaagcaaaagaatttctccttgagatactggcaaatggaggaatgactcagaagaaaattgcagaagaagcagaagccagaggaatcaaaagtaaaacgctatggaacgccaaacgggaacttgaaattgattccgtaaaacgtggaaagcaatggtattggatgttgccagaataaaaatggaagatggcaagattaccatttcttaagaagaggggatcttgctaccttgaaaggagaatagatgcaaaataaaagtgtacagattccatacgagttattctttcagctcttgcaatattttttgatggataactacgatggtgaagaaataatacggttgggattggagaaaaaactggatgcaatggtgaatcgtgaagtatacagcaaatccaaaacagcaccaacggaagaagaaagagaaaagttccggaaggaatatctggacagacggggaataccggagaactttcgatggtaaaggttctttctgaacactttattacaggagcgtgtcacgcacctgtagatagcagacaaggagaatgttggtaaggtgtagtcgggagttgactggcgtagaagagaattttcaaaagggagccctgattcagggcgcccctgcggaaacggtagatgaaaggagattggcacaatgagagaaggaagattaggatataacagttataacaaaagatatggattattatcatcagatctatggattgatacaggatttcactgtggagaatgcctggaagtgttgcttgatgatgaatgggttcagaccagaatggaaatgaatcctgcaagagaatggtatcttgtagggacaccgtattgtggtgatttggaatatattcgggcaaggataccggagtaaaggtctctgtacccccggagggcgcaagggtacttttgatggacggtacggctgtcgaaagtgcttttgcgttacttttgacaaaagtaacaaaaccgccgtatccggcgaatatttctttttatactatagctggcaaagatacaaatttatgtgccatgtctggcactggttttagaaagcggggtgaggaatatgacgatgaaacgaacaatcagtggtatgatcgggacagggtctctggctcataacagacgagattttatagcagaaaatgttgatccagacagagtgcaattaaatatttgttaccggaatgagaatctgaaagaagtctataaagagctgtttgatgaagctgtagaacggtataatgtcgggaaaagaaaagatcggcagattacaaattattatgaaaagattcgccaaggaaaacaggaaaagttgttccatgaagtgattttccagattggaaaccgagaagatatggctgttggaacagaagcaggagatctggctgtaaacgtactggatgagtatgtaaaagatttccagaaacggaatccgacacttcgggtatttagttgctatctgcatcaggatgaggctactccacatctccatattgattttattccttatgtgacggactggaaaggaaaaggaatggataccagagtttcactgaaacaggcattaaaaagtcttggatttcaaggtggaaataagcatgatacggaactgaatcagtggataaatcatgaaaaagaagttctggcagagactgcaaagcagtatggaattgaatgggaacagaaaggtactcatgaggaacatctggatgtctataacttcaagaaaaaagaacggaaaaaggaagtacaggaattggagcaggagaaagagcatctaactgctgaaaaagaagaattaacagcacaaattgcagaatccagagcagatatccagaatttaaaagacgataaggaacaggcaatcaaggcgaagcaagaagcagaacaaaaggcagggagcgcagaaaaagaactaaaaagcctggaagatcgcagagaacagctacaaccgattatggatagtgtgagcaaagaaatcaaagaatatggaacggttaaaatgttactgccggaggcgggcacgctagaacgggcagtaacctatcgagataaaaaaattaaaccactgtttcttcaaataaagaataaggttgctgtaatggcggctcaggttaaagaacttacgaaagaggtggaaggttggaagagaaaatatcaaaaggtgaaacaaaaatataatgctattcagagagaactggatgatatacgtaaagataatcagaaattgtcagaagaaaaagatatattacaaggtgtttctgataggtatgatcgtgttgtgcgtgttcttggaatagaaactgtagatacagcagtacagcaggatattcaaaacgagaaagtcctggaagaaaagcgacggatggaacaaatgccgaagggaaatattcatgaaagattggcatggggaatgaaaaaaagcgagatggagaatcagcagcgtaagaaaactaaatcaaaaaacagagaaatggagagataagattatggaaacacacatttatgatgaaaagaacggattaagctatactttgcatggagattattatttgccggatttggtattgaatgaagaagaaccgatatatgggaaatatggaatgctgaggaaacagtttctgaaggaacacagattagcaaaatatcaatatttgttgttgactggaaagctgacggaacacctgaatcaaattgatcaggagagcagagagcaggtggaaatgcttatggaacagatggcagaaaaacagggcgtaactgaagaattaaaggtacagaatcggacgaagtgggttagactgatgaataatataaaagctagtgcagaagaaatggtgttgaaacttctgaaaagcacattgtttgtaaaactccctgctattaggttccacattctcacctcctttctcgttggaaagttggtggtgcttcccccttttcgcggggcaatacggcgtttttgaaaaacgccgaagattttttgaaattttttcaaaaaattttttgagcagcaaaatacgcctgtccgaaaagcccggacaggcgtataggtattgtaagcagtatttagatgattagacagttcatagtcaagggtagagaggttcccggcggtggtcgggctttttttgatatgtcaatgaccgtcggattttgtcgatagggtatgtgcttcatggcggctacctcctttagccgccgcttttaacagtgataccgcgtcatttcattagaagataaaaagaaacggcggctttgatttttcaaagctgctgcggaaatcaaagaacgacaagcaacagttctgattttgctccaatatggttattaggggcacaaattaaaatcaaaaaagagccgataacagcagtatttcaaactgcatattatcggctctgcgtctgtgcgtctggctcttttaattaaattatttctgttgttttttggctttattatatgtattagctaactgtccacaagctgctttaatctctctaccatgagaaactctcatggtaacttcaagtcctgtttgctctaattgatgtttgaacgcaaccatttcttgtttttgtggtgctctaatttttgaattactcgtcgggttgtattgcagcacgttaatcataacatttttgcccttaaaccattttgcaagttgccttatatctgaggaacggtcatttatacctggtaaaagcaaatacgcaaataccacttttcgattatgcctttgagaataggacaatgcttgcttaacaacatcttcaatagcgtacatgtgcatatgaggaatgatacagtttctcgcagcctgtgttgctgcatgtaaagatattgtcaactgaatttttagatgttcttcgcgcaatttttttaattgattaactggaccaactgttgatacggtaatgccgtcggttggaaagttaagtccatttctatctcgaagaatatggattgctgcaatcaagttgtcgtaattgaataaaggttctcccattcccataaaaacgatacgatttactttttgacgtatcaatacaacctgctgcacaatttcagacggtgttagattacgaacaaaaccattgcgtccggactcacaaaaaatacagccaacagaacaaccaacttgcgtacttacgcaaacagtcccaccatctcgccgtttaataaaaaccgtttcaatatacctgttatctttcaattcataaacatacttttcagtatcgctacttttatagactttttttgttgatattgatagattttctttgtgaaatggctgtttatacaattccgtatataaggctcttgctttatcctctccaattacttccgacatttctttgtaagtaaatccgtatgggtcattcaatatttccgtaggtgtacttttaggtaagtgtttcatttaaatatccttccttttcaaaattaaaaagtttgtttttcagagtttttgattatgatttctagtttttcaacatcaacgatatgcgttaatttacatttagggcagaaaagaggaaaatttcttaataccgtattataaaatacttgaaccctcgtctttccgttacaaattggacattttatccaatatttttcaagcataatatttctccttttgcgcaaaaaaatgcaggtcaattctcaacatgagcattgacctgcatttatacatataatactacaacaaaattaaggcatagtttttatactatgtctatacgtcgttagttttgttgtatagcatacgcaaaataagcatgacaaaaaagcccatattgaaaatgggaaaaatcttttttgatttcaatgcttatcgaatacgcatgctatgtaacataaacattccccccttttatataatattatatacaaaagcagcttgttgtcaacatatatatatatgaattattttggctaactgatagaactatgtagacatatccaagaagaaaggggaacagtaaaatgtaagagggtgaataactatggcaaaaagaccagtaccaaaatacgacttcaaggcttttggggcagcgataaaggcagcgcgtgaaggacgcaaggaaagccgcaagaaagtaggcgacgaaatgtttatctcgccgcgctaccttgcgaacattgagaacaaggggcagcacccaagtttacagatattctttgagctgatacagcgttaccatatatccgtatctcattacttccagctttggcacgactattgaaaattgatatgaatgaattgttttcgtttcatgaagaattgacagaaaaagagattggacaatttgtgaatgaactttcggaagtttcattggacagctttacagaggctttcgagatggcatctcgtaaaatacaggagtatcctcattgcgacttattaatatatacgatcgcaaccgttctgaacggatctttgactttgtcagatcttaatgacgaagaacgaatggaatataatacagctattattgagtggctggaacgaacagcagatagtcaggatgaaagagtgagaaattcaagcgtttttatacttgcaacaaaatatgtccaaatggagaaatatgaagaagcaaatgcccttttgaaaaaaattcctgatactgtaattgatgcaacgattatgaaaacaagtgtattagcacatcaggaaggaacagatactgctgcattattcttagaagggaaattgctacaggcagttatcaatatccaaagctacttgtataagttaatagaaatggaagaagagacaggaaatcatgataaagcagagaaaattgctgagattacagatcacatgatatcattgtttggactatggaattatggcaacacagttccatatctgctgattgctggatatcgaaaagatgtagaaaaatgtatccagttaattaagcgattattaagtgaatcacagaagccttggaatatgacacaatcccctttgtattacaggtatgaagatactgcacagggaaaagctttttcgggacttggaaaaaattttgttcgtgaattgtattcggaaattgaaaataagaaagagtatgaattcttgagggggaataaggaactcgaatcaatttttgaggaacacttgaaataggttgtaaaaatgtatggaaatagatgtagttgagaaagaagaaaatttttgacatttccacagatgcgtgctaatatgattatagaaaaagagtgctaccgatagacggttagtccacatacttattgattacaaaaataaccgttcagtttgcaggctggggcggttatttttgtggtttatgattatctttgcctaatgtatatccgatactaaagcaggttaagccgaagctcactactgctatgaagtccacaatactcattggcttagccctcctttccactggattcctttacaggtttctatgtaatcagagggtcacagtccctctggagaaggactaaccgcctaccgttatggtagcacccatgtttcgattataacagttaaaaattaccggtgcaatataaagttggtagagaagtatctagtatctacagaagagaatcggtttgagtattctccggtgccaaaacggtgccaagaaatcaggcaaatcaaaataggtggtgcaattcagctgtttttcactgtattttggagagaaaaccataaaaaatatgagataaaacgggattaaagtatcgtgaaggtggacgtactgtaggatcaggacgtgttgctacaatcatcgagtaatacaatctgaatatagatttgttatcgtaagataacgttgtgtccaaacgtaagatacccgtagaacttcggttctacgggtttttctgttgcttggaaatatacaaaaaagcggaaaagaataacgaacagtatagaaaagcggttgccgggagagtgtcctgacaaccgtttgtgataacagaatgataacaaaattaataattttcgtaaatatgataacagataaagtagatttatccacaaatcaaagatatgactgtggattaagtaagatcatacgtcttgatgtcattaccttcagtgcccttcttaacgatggtatgacaacctatcgtagttcccatggcacgtagcttccattcttcctgggtagcgttcagtttatccagttcttcctgtcttttatcttcatcttcaatagataatatttcagctttttccttttcatagacatttttaaattgacaccatttcttgaaaaagtcctgcattgtaggattatcgaatgtcagcgcaaccttctgatcaggtgtttcagcaagtgagaggttcactgaatcatcaatagaaaacaacagagagagtacatctccgactgtttcaatattaaaatccagaaaaacacttacatttaatcccagtgcagttgctatcttttctaactgatccggttttggattccgaattcccagttcatattttctgattgttcctacgttaatgccggacagctcggctaactgtatctgactgtatcctctaaattcccggtatgcccggatttttttaccaaccataatgctgcctccttaataatatttgtgcttctattctagcacaaaagtgaatgatacaaaagagagagatttaacaaattgtcgatacgcaagcaataggtatggaatgggaaaaataaattcgcaaatgtttattgacaaattcacaaaagtgaattattataagagaacaacgaaagagtcacaaaagtgactggaaaggaggacgctatgagaactaattatatgatgaccgttgatgatgtcatggaagaattaggtgtgaaacgcagtaaagcatattccattctgaagcagcttaatgatgaactggcaaaggaaggatatgttgcagttcgtgggaagataccacgtccttactgggaaacaaaattttatggatgctctcagagagcagtatgaaggaggttttaagatgtcagcttacaaagacaaaacacagggaacctggtatgtgagtttccgttatattgactggacaggaaagaaaacgcagaagctgaaaagagggttcaaaacaaagaaagaagcattaaattatgaaaaggaattcataagaaaaactgcagcggatatgaaaatggagatgaacagttttattcaagtttattttgaagataaaaagaatgaactgaaagaaaattcaatccgtaataagcaacacatgatgaacaagcacattgttccatattttggaacaagaaaaatgaatgagatcacaccggcagagattatccagtggcagaatgccattcaggaaaaaggatacagcaagacctatgagcgtatgattcagaatcagttaaatgcactgtttaatcatgcacagaaaatttacaatctgaaggaaaatccatgtaagaaagtaaaaaagatggggaaatcggatgcaaataagctggaattttggacgaaagcagaatatgacagatttatcgccgggattgagccggggagtgaagattatctgatatttgaaattctgttctggacaggaatcagggaaggagaacttctggcattgagtctttcggactttgatatgagtggaaatcttctgcatatcaataagacttataaccggattaagaaaagagatgtgattgatactccaaaaacagaaaattcggtccgtactattgacattccaaattttcttaaggaagagctacaggaatatgcaaagaagcattatggatttccggaagatcagcggttgttcccgattgtggcgagaacactgcagaaacgtcttaagaaatatgaagcacagaccggtgtaaaaccaatcagagtgcatgatatccgtcacagccatgtggcatatctgatctatcagggcgtagaaccactaattatcaaggaaaggttggggcacaaagatattcagatgacactgaacacttatgggcatctgtacccgtcacagcagaaaaaagtagctgagatgctggacaataaacgttaatacggaggaaaaagcaaatgaaaacaaagaaagtagtcggaaaaatatttgatgcaattaactacagtaagaagttgaagataagttccattttaccagatcgagattcagattatgtgattcttcttgaattagaggacggaagcaaatttgaaattatcattattcctacaaggagatttgtgtaaggagcaaaagctatgactactgacagaaaaaaagaaaaagcccagacaaaatatctgagcaagttctctgataatcagattcactgatataccatcttggcagattaagtatatcacgaattgaaagatacaacaattcccgaatatctgttcatcagagacttgcccggaggggcaggaggtagaagtgacattatttgaacaggtaaaagaatgtgtgacagcgagacaggctgcggagcattacgggattaaagtaaaaagaaatggaatggcgtgttgtccgtttcataaagaccgacacccaagtatgaaggcagataaaatgtatcattgctttgcatgtggagtgggcggtgatgcaatagattttacagcaaggttatttggaatatcacagtatgaagctgcgaaaaagctgatagaagattttggactggatattaaagtcgaaaacagaaacaaatacaaaagaacgcaccaaagcaggaatactttgaaatcaaagaaacttaaagttgtgatgatcagagaaaaactggagcagtggttgaaacatgcaacagacgtgctgatcagatatctgaaatggattcagttctggaaagagttttacagaccagaaccagatgaagagtggcacgagttatttacggaggcattggcaaatgaaagaaagataaatgactatctggacgtgctgatgtttggaacaggagaagaaattgtagagtttttcaagatgaagagaagggaggttgatcgaattgagaaaagaattaacgaatatcagcgagaagtccttgatggaattagaagatattgtgaatgaggagatgcttacagtagaagatgtcaatgaaatgctggagcataccgataaaggaagaacaaagcagacaatcagaaattgtgtaacggtacttcaaaatgatccagtgctgaaaaaagcaattaagaggaatgaactttccggaagaatagacattgtaaaagaagtaccctgggagcgaagaaataacagtcctacggttacagatacggacgagtataatttgaaaatgtatctggaagagaattatgaaatcacaagcgagcgtgtgatcaaagcaggagtagatattgtttccaatgaaaataaatatcacccaatcagggattatctggagagtctggtctgggatggggttccaagaatagaaaatatgcttccgcattttctgggagcagaaaagagcaaatacacaatcggagtaatgaaaatgcacatgctggcagcgatttcaagaatttatgaaccgggaataaaatatgacattatgttgtgcctggttggaagtcagggagccgggaagtctacgtttttcaaatatctggcaataaaagaagaatggttcagtgacaatctggatcatctggatgatgaaaatatttacagaaaactgcagaaccactggattatcgaaatgggagaaatgaaggcaactatcacagcaaagaatattgaacagataaaatcgtttctgagcagacagaaagaaacttacaaagtgccatatgaagttcacccggaagacagaccgagacagtgtgtattttgcggtacttcaaatgatctgaattttcttcctttggatagaaccgggaacagacggtttgctccggtaatgacaaatatgtcaaaagcagaagttcatattttggacaatgaggcagaaagcaaagcctatattgaacaggcctgggcggaggcaatggtactgcatcgacagggaaatgtgttcttagggtttacaaaggaaattgaggaagaggcaaagcgtctgcagaaggaattcatgccggaagataccaatgccggaatcatacaggcatttcttgatgattgcgatgatgattatgtatgtaccagaattctgttcgatgatgcattacatcgaaccggagaaatgaaacagtgggaaggtaaagagattgcaaatattatgaacaatgcgattgtaggctggaaaccacatggtacacatcggttcggaaaggaatatggaatacagcggtcatggaaacggatggaagattctttaaagaaagataaagacggatttatggaagtaccggaacagttggaaataccgtttaagtaaagattattgtaaacgatgtaaacggaactttaaggaaaaacttaaaaagttaacttttaaaatcttttaagccccgtttacaaattccgtttacagactggaaaggagcagaaaatgatgaaacagggaagattaggatataacagcagcaatggaagatatggattattatcatcagacttatggattgatacaggatttcactgtggagaaggactggaagtgctggtagatgatgaatgggtacagaccagaatggagatgaatctggcaagagaatggtatctggtggggacaccttattgtggagatctggaatatgtgcaggcgaggataccagaataaacgagctacaatccacttcggttggtgcagaacagacgtccataaggacgttatgcccccggcagggcgcaaggggacttttgatggacggtacggctgtcgaaagtgcttttgcgttacttttgacaaaagtaacaaaaccgccgtatccggcgaaagtttcttaatatcgccatatctggcgtaaataaaaattatgtgccatatctggcactcaaacagagaagaggtgagaaaacatatgataaaacgaacaatcagtggcgtgatcggagccggctcactggctcataacagacgagattttgtagcagaaaatgtaaatccagacagagtacaactgaacatttgttataagaatgagaatctgaaagaagtttataaggaactgtttaacgatgctgtggagagatacaatgtcgggaaaagaaaggaccggcagattgcaaattattatgaaaaaatccgacagagcaaacaggaaaagttgttccatgaagtgatattccagattggaaatcgagaggatatggcagtgggaacaacagaaggaaatctggctgtaaaggtattggacgaatatatgaaagatttccagaagcggaatccgacacttcgggtatttagttgctatctgcatcaggacgaagctactccacatctgcatatcgattttgtcccttatgtgaccaactggaagggaaaaggaatggataccagagtttcactgaagcaggcattaaaaagtcttggatttcaaggcggaaataagcatgacacagaactgaatcagtggataaaccatgaaaaagaagtgttagcagaaattgcaaagcaacatggaattgaatgggaacagaaaggaacacatgaagagcatctggatgtttacaatttcaagaaaaaagaacgcaaaaaagaagtgcaggaactggaacagaaaaaagaatatctgacagcggagaatgaaggtctggtttttcaggttgcagaagcgagagcagacattaagctgctggaagaagaaaaaattcagttacagaaagataaagaaacagcggaaagacgtgctgagaaagcagaaacggaattgaaaaaactggaggacagaagagaattcctgcaaccggtgatggataatgtcagtaaggaaataaaagaatatggaatgatcaaaacatttttgccggaagctacagcattggaacgtgcggtaacttatcgggataagaaaataaaacccttgttcattgaaatgaagaataaaattggtgcgatggctgcacaggttaaagaacttaccagagaaagagataagtggaaaagtaagtttcagaagaaaaagcaggagcacgagaacactaaaaaggaactggcagaagttcagaaggattatcagaaattatccggcgagaaagaaatattgcagggacttgcagacagatacaatcgacttttacgtatgctggggaaagatatggtagaacgactggtgcaggacgatatccggatgcaggcggaacttgaagcgaaaaagcagaaagaacaaatgccgaaaaaaataagtgatcgcataccatgggcgaaagaacaaagtgaagaatacaatgcacagataaaaaagaacaaagcaaaatacagaggaatggagttgtaagaatatgaagaaacagatttatgatgaaaagaacggactgagctacacattgcatggagattattatctgctggatctggaaatcaatgaggaagaacctacatatgggaaatatggaataatgcgaaaacagtttctgaaggaacacaggagtgcaaggtatcaatatctggtactgaccgggaaactgacggatcatctgaatcaggttgataaagaagtaagagaaaaagctgagatactgatggagcagatggctgaacagtggggcgtgacaaaagaactgaagatgcaggatcagatggaatgggttaggaaaatgaataatattcgtagcagagcagtagagattatagatgtagaattgatttgtgtttaggaggacaaagtggcagatataatgttaaaagtaattgcgtgcgcacgcatattgtattataatactggtggttaggaggaatatatctatgaaactattaaaatggctttcagtaacagaccgattttacaaaatctatttagataaacagcttgccccctttggaatcaacaacagccaatatatgtttttgattaaaatctgtcgttcgcctggcattttacaggattctttaatggatatgttttatgttcatccgagcaatattgtacggacagttgcggcattagaaaagcagggaatgattatgcgttccccaaatgataaggataagcggacgtgtaagctgtatcctacggaacgtgcgctgtctgtaattgatgaggtacagacggtatgtgaaaagacagaagctcttttattgcaaggcttcagggaatctgataaaaacctctttattgatttgctgattcaggcaggtgaaaatattacagcggaactccgtatagaaagaaagggggatgaatttaatgactgagaatcccctaggctatgaaaaaatttcaaagctgttgaaaaattttgctgttcccagtattgtggcgtctcttatcggctcaatctacaatattgtggatcagatttttattggtcaaggggtcggttatttgggaaatgcagcaaccaatgttgcctacccgttttctaccatctgccttgccattgcactactggtcggaattggcagtgcttccagtgtctccctctgtcttggacgcaaagagccgaaagctgccgccaaagcagcgggaaatggtattgttctgatgggaattttcggaattatttatttgctggttggagaaacttttctgtctttgctcctaaaggcatttggggcaacgacagatgtatttccatatgcaaagcagtatgccagcataacattgattggaatgccgtttcttattgtaacgaatggtatgagcaatttgattcgagcagatggaaaaccaaagtattcaatggtttgcatggttatgggagctattatcaataccattcttgaccctatttttatttttgcttgcgattgggggattgccggcgcagcttgggcaacagttattgggcaaattttttccttcatactcgcactccgttatctatggcgtttccaaacaatccattttgaaaaagagtcgtttttattggacatcaaagaaagcatgaaaatttgcagcatgggaatcagcagcagctcaaaccagattgcagttaccgtgattcaaatcattcagtacaattcgttgacttattacggcgcattaacaaaatatggaacagatattccattagctgcttgcggaatcgttatgaaaacaaatgccataatccttgcgattgttgtaggaatctcgcagggaacacagccgattatcggcttcaactatggggcaaggcaataccatcgtgtacgggaggcttacctgcttgcggtaaaatggaaccttgttgtttccacaattgctttcatcgcatttcaatttttcccgcaatctatcatttcgctattcggagatggggacgagctgtattttgaatttgctgttttgttcatgcgtacctatcttttcatggtgttggtaaatggtgtgcagttgctttcttccagtttttttaccgcaataggaaaatcgttaaaaggtgctctgttggcattaacaaggcagacctttgtgttgattccgcttaccctgctgctcccgcttcgtttcggaattatgggagtattgcttgcgggacctgttgctgatttttcagcgtttatgctatctgttgtgctggtgggtatagaattaaaaaaacaaaaaaataacatgtaaacaacagccctatgtgaaaacattctttttccgccgttaagtaatcaagaagcaaaaacttaaaaaccgttgcgataaattttataaatttagtaggataatatttagaagtaaggattgagaaaaatatggaaactataaaatgggttctatgtcctatctgtggaaataaaacccgaacgataatgcaagaagataccgaattaaagaactttccactctactgtccgaagtgtaaacagcaaacacttaactgatcttgcaaaacggagaaaaacagtaattatagcaacacataatgctaatattgcagttggcacacttccgtatattagtatactaagaactcatgagaatggagtatataaaacgtatattggtaatcctttttatgatgaacttagaaatataaatgatgaaacagacactaaaaactggactcaagaaagtatgcatactcttgagggcggtaaaaatgcattttatgataggaaggatatttatgaatcaggaaagcaaagtgattaatgtacatttggagaaaagagaaaataaagattatttagtatttggctttgaagaagttgcagaagtatgtcttaatgatgatgagagtcaaaataatttgaaaagtatatttgtaaagttacttacggagattacaaagtatccaattgaattacagtttttggaaaaaccagaatataaaacaggattatatatagatgtgtgtaaagaatatataaaagatttaaataaagagattacgaatgtaagaaaaaatatgccagaaaaactaaaaatacagtgataacaccatgataacaaaaattccggaaaaccacacggacacaacggaaaatccggatttttccacacaaatcacataaaaaatcactattcgtataccgcaatacaccggtctgatatcgtgaaggtggacgtactgtaggatcaggacgtgttgctacaatcatcgagtaatatacgcgaaagcaatgaataaagcgccaatcaaggcgataaaaaaagagactgcaagctcgcttgcaagtctctttttttatcgccttggaagtgggcattttacgaatgcccgcgaacgaacgacgaagtcgtgagattggcgcatatacaagagatttgttatcagaatattaactcaagatatagaccctagaggcttaggcttctggggtttttgagttgcataaaaagataagaatagagttttgctatacaatatggtatacttagaaaaacgcaatgcaaacttggctttaggggaaaaacaaatggcttcaagaagttttagagtatttggaacaagaacagatttagaaagtgtattttatgaatttcaaaaacttaatttagttaaatattataaatgtggtagaaatgagaataaaatcgatgatattactaaaactatttattttggtatttctctcaatggaagtcacataagaaatcaatatcttgttataaaagatgacaaatcaatatgctttgataaatataaacatatatctcaatatctgaatgaaacgagtgttgctattaatcttggcggattatatgatgaaaatacaattgtgcctacaactgtatctacaatatggtatgacaataaaattagcaaagaaatcttcaatgatttaagaaaaattatgaaaagatatgcttctacaactatcaatggatatatgatattaaaaaatgcttatagtaaaaaggagcagttacgatttgtaactataggtgctcaaagcccgagagaatacgatttaatagtttaacgaaattatgagtttacaaaaaagtcagataacgatggcattgcatagccaatagtggagggatgatatggcggtaggatttaaagtaggttattattggtttcaagttggaacaagtgattttttgcattcttttttttctacgatatgtattcggctcgaacatggaaaatgggggcgtgtttatcccaaattaatgggagaattatatcaaggctgtttaaaaaatcaggatttaaatgaagggctggaggaattgcgtaaagtaagaaaagaactgaaaaacttttcgccctctgatgtaatatgggatgctgaagacttaagtttaacaccgccttggggaaataatattagttcagatattacagatttgtctaattattttgttaccagtgatggaagagatttgatttccgttttaagcgaggcgatgaatgaagcaaaagaaatgcagtgcgatattgagattgataatttataatagtttaaaaatcagaaggaagagttccgattatagtaattagataaacttgattttacaaaaataaatcgaggaaagggagtaatatgaacagtactcttattttttatatatttttttgtataatgttgattagctcggtgataattatcgtaacacgctggaagagatatacgaaatattctaacgggacatatataaatgcaggacagaatctgatatttaaaacagaaatgtctcaaagtgaaataatccggcaactgaaaactcataatgccaatgatacattagagtatgatttttttgaaaaaaataacgaatactttcttgaagtaaaaggtataaaacgattattttttaatggaatattgacggcaacttttaaagttgaattttggggaaatacacaaaagtatattattattcatcgatgtaataactttcagttattgtattcatctggatatgaagcggaaatatttgaatttatggtaaaaaaattaaattgcgttcctcaaaaatcggtaaaagaaatttaatataattagatgtcagataattgcgggttgtagaattgagaaagggataagttatagtaaaggcagcaaaaagttatcaacaaaaatatgaaaaaataatgggtgagtctagtgaagatgaactttggagtgatattgaaagggatatagctgaatttaaaaagaaagtcgaatttggaaaagcagacggatacttctggaatatgtattttaatttgctgcgcagcaatagacttatgtttgcaggaataaataaagcttttataaccggtgatatggcttatatgttgaatgggatttatcaggaaaatcgtttcaattgcatttatggaaatagagcgaatagcggaggagcacagacaattaatttcattgaagttgtgcttgcttattcctgtaatgattacaagctgttggaaagaatcatgccgtttgaggcagggcctgctagttccggttattcagctccgtattataatatggtttatgccatgacatatcatgatgatgaggtgggaaagaaagctcaggcagaattaagtacatttatggagaaaaaacggacacaatttgatttaaaactagcaaaatttttctatgatttatatcagaaagatgtggacggagttaattgcggattacaggaattgtgtgatcttatgggaaaatgtaaatggattaatgaacacatttatgggctggataaagacattcaaactttgggaaagatggtggcaatatttatacatggtttgtatcatatagctatgaaatttttggaagacagtccattgcttgataagattaagatgcccgaacataagagctttataaaagaatatgaagaatttaatatagagaagaattttccggaaccgcataatttaattaattttgatccgattgcaaagtttataaatttaagtataaagacagaaatgataccggaagtatctttcagtaaatcaggaagaatgtatgtaaatgacggaaaaagatttgaaaaaaggttgtttgctaatttgcaaaaaagtaaggctttaccatttgaattaaaggaagaaaaatataaactgccagcagtatataaagagttcatatgtaaatatgatggtctgagcttagagaatggctgcacattctattcgcttgaagaattagatgctatgaataaagacttgcaggtaaatatatatcagccagataccgttgctgttggagatgatggtggtgacctggtctttctgatgaagcaggaaaaagaagcgaaaaccgtttatctggtagatgcgggtgattatgatttggaaagtccgtatcaaattattccggattttaataaatggatggaaaaaggatttgaaatcgaagatatagatggagaagatgtaagaggagttgactatggtgatctatatttaataaaaatgccgaaagaaggagtaaaaggattggtaacaataaaaagggctttcaatttagaaatgagtacgggagagttattgcaaaaatcgaaaagtttgccaacaaaattgttatcaaacatcacaagttcaaaagcaaatataatagctgagaaaataggcatgccaggactatttgaaataaggtaagaacattttgacatttccacagatgcgtgataatatgagaaaaagagtgctaccgatagacggttagtccgttttactatttagaatatctatcaaagataaccgcttagtttgcagacagggcggttatttttgtggcttattattatccttgccaaaggtatatccaagaccaaagcaggttaagccgaagcttaccaccgctatgaaatccacaatactcattggcttagccctcctttccagcggagtccctttcgggtttctatgtaatcagaggggtgctgagtgccggtggcactcgtttagcaccgaccgtaacggagtgtagaccacagtccctctgccagaggactaaccgcctaccgttatggtagcatccatgttctgattataacagtcaggacaggaatccgcaaccggaaagctgccagtgcataaaatttgaaaaatggaactgtgataccattttgatactaaaaagcaaagagaataaaaatctatatttatttagatagatgaagtatcaataactatgaaatgctagaaaaaataatgatgtataagaaaggcggtctatatgggaaaaagaataatttctgtgttgttaattgttgggatttgcctatctgtgactgcctgttcgccattagagaatctttttgatattatggatcggattactgataatgataatcctttgagtggaaaaagtacagatgaaagaattgttatgtccttggaagatacatatccggaacacactttttcagcaataaattcgtttgacaatgataaaggagaaggatttttttctgacgaaaaaggaataaaattcagggtacacaatcttatttataataatacatatcattttggttgtgaagatgattatttggcaacaatcttaaatgaacaaaattatattagccaggcatcagatatagctacaaagtatggatatgctttagcatatgatgaagaaaatgaaattgtatctatccaatatgcggaagattttcagcaaacagatgatttttcatattattcaaaaatggtgtatgaaattctaaatgtcgtggagacaccaacggttgttgatccggatactgagttttcaacgggagaagttaattattatagtcgcccttgcatggggacattgttgtgtgatattacctatcatacttccaaaacaagtgtgaggattagctttgaagataaggatttatctgaagaacagatccaagcaaaatttaaggaagaataccaatggctaaaagaaacacaagaataacaacttaatattctggtgaggatagacgatgaaaaaaagaaaaatacttatgttgatacttttggtgtctacagtattgctgtcaggttgtgggaaaacatttttgagtagattatttaaatcagaacatgaagaatatgctgaaattcttacggcttttttggctgcggcaaatcaaaatgatacaaagaaaatagaagaattatttgctcctaatataaggggaaaagaatttcaaaaagaagtggatgattttttggaattttacaacaaaacagcaaaagatgggacatgggataaggatgatattttgttaggagtaacgggaagtcaggatagagatctttatcgtgtcatgcattcttcgatagaattaaaaaaagataataagaattattacatttatatggaagttgttacagcggataaggaaaattcagaaaataaaggaatccagattattgatttagcaacgaaaaaagcatatgatgacagatattttctgtggcattcaaaacagggaatctatgcgcaggaaaaggcttgtgaagattatcaatcaatgttgatatatggaaatgtaagagaatattatacggttgacagagaactttccgttgattattttaaaaactttttgaagagaagtacaagttataaagaacttcagaatgagattggtgagcccaatggggaactgataaatgatgaatttatttatgaaattacgcagggagcgaatgaaaaaacatacataacttgtgaagttctaggagatgaaatcattaaattagaagtgtgtaatgaagaaaaagtgattgagacgatttatgaaaaaaatgctgaagagaattaaattgtaagttggaggtattatgaatggagactatgaaattcccattttcagatgcgcctaatacagcgtgctttacttgttgtcatgtattagaagaaaataagcctatattatatgtttcgcatgatgaagatggatattggcagttcttatgcggtggaaatcataaggaagaagatgtaagagtggtttcgttagcatctattttaaggattgatgaaactagaacgaggtttccgctgtcaaaaaatcaggaaaataaaaatagaccatgtaaatcagccgtttttcactggtgaaaaatgcaggtaagaatgttttcatacttacctgtttttttattttatgccctaagaaattatgttatgatgttaataaatagagatctaaccataagacattaataggagaagaggaaatatgcagaatccagaaatcctgattataggagcggcaatcatagatgtactggccagaccggtgaataccaaggtatttgatacaggttcctaccctgtcgaagatattcatatgacaacaggaggggatgcgctgaatgaagcaacgattcttgcaaagacaggacataaagttcaattagaaacagtaattggagaggacgaagccggaaaattcatattaaatcactgtcgggaatgcggtatggtcatcagaaatgaaagtgtaaggaatgaacagataaccgggatgaatgtggtgcttgtggacgaaaacggatcaagaagttttttgacgaatccatatgggacactcaggagtcttagaaaggagtatatccggatgccgtttccggatagtgtgaagattgtatgttttgcaagcatttttgtgtttcctgagatcggaccggttgaattaaaggatatatttaggatcgcaaagagacaggggaagattgtctgtgctgatatgacaaaacgtaagaaagacgagacaataaaagacatggcagatgctttttcatatatagattatttattcccgaacgacgaagaggctatgcttttgacaaaaaccagaaatgtagaagaggctgcagaacagatcaaacatactggtgtgggaaatgtaatcattaaatgtggaaagcgtggctgttatgtaaggacagatgaggataaatattggattccggcactagaagatgtggaatgtatagatactacaggggcaggagatagttttgcagcgggattcatgagtgcattgctggctggcagaagtgtaatagaatgtgcagaagaaggcaatagatatggagcaaaagcagttcaatacgtaggatcaacagaatggttaagacatgaaatattagatggtaaatagcaaaatcaatctgaaaaattcaaaaccgatcatatttggatgtctatttagcatgcgtgtgtttttctatgtcaaaatatatgcatttctgtctgttagtatcaatcatatagagtatttcaaaggaaaatacggaatactttacacagaaaatatccttagaaaaggagttcagattcttcaggaatccgcaaaagaggatgtaaaaatctgcagggtatcagagaatattttttgcttctggctaatggaaccggtagaattagagctctacatacaacaactaaaagaggcattcagaaaaaaaggggaggaagagaatctgccattttctttctcgataggtgcaatatacaataatacaataggaaaagaaaatattgacgaattgattgaccggtgtggaaagatgcggcttttgaacgaaaagcatgcagaagcagagtttagtgaaggaaaaatgaagatgttataaaaagtgattatggaggtaaaggatgttatacataggtgtagatctaggaacgtcagcagtaaaacttctggtgatggatgagaccggagacattaaaaagattgtttcgaaagaatatccgctcttcttcccgcatccgggatggtcagagcagaaaccggaagactggtttgaaaaatcgatggaaggaatcaaagaactgacggcagagtgtgataagtcacaggtagcaggaatcagtttcggaggacagatgcatggattagttgcgttggataaagatgacaaagtcatccgcccggcaattctatggaatgacggaagaacaggagaagagacggagtatctgaatgaagtgatcggaaaagagaaattgtctgagtatacggcgaacattgcatttgccggatttacagcaccaaagattctctggatgaagaaacatgagccggagaattttgcaaagatcacaaaaatcatgctgccgaaagattatctggcttataagctatccggttctttctgtacggatgtatcggatgcttccggtatgctgcttatggatgtgaagaatcgctgctggtcaaaagagatgatggacatctgcgggattacagaagataaactgccaaaattatacgaaagttttgaagtagttggaacgctgaaaaaagaagttgcagatgagcttgggttttcagagaatgtaaaagtaattgccggtgcaggagataatgctgcggcagcagtgggaaccggaacagtcggggacggaatgtgcaatatttccctcggaacatccggaacaatctttatatccagtaacaagttcggagtagacgagaacaatgcactgcattcatttgcacatgcggacgggtactatcatctgatgggatgtatgttgagtgctgcatcctgcaacaaatggtggaacgaagagattctgaagacaaaagattttgcagcggaacaggacggaattacaaagcttggcgaaaatcgtgtattctatctgccgtatctgatgggagagagatctccgcataataatccggatgcaagagcaatgtttatcggaatgtccatggatactacccgtaaagatatgacacaggcagtattggaaggggttgcatttggcttgcgtgattcactggaagttgcaagaaggcttggaattaagattgaaagaaccaggatctgcggcggaggggcgaagagcccgctctggaagaagatgatcgccaatatcatgaatctgaaggtggatgtggtagagagcgaagaagggccggcgcttggcggagcaatgctggcagcagtaggatgcggagcatatccggatgtagaggctgcggctgccaagattgtaaaggtcgtagatacagtagaaccggatacggaactgacaacaaagtatgaagaacgataccagcagttcagggaaatctatccgactgtaaaatgcttatatgaaaaatgttgatttcacttccgtggataaggcggatatgttaaaataacttgaagagtgaaatcttagataaagaggtatgagatgtgtaattctcatacctcttttttaagacaaaggaaaaagaggaggaaaatgaactatggaaagtcataagattatccaggtagaagaaaaagtaccattgaaactattgctgccacttagtatccagcatatgtttgcgatgtttggggcatcggtgctggttccgttcatattcggaatcaatccagcgatcgtactttttatgaacggtgtgggaacgctgatctttatcgtggtgacaaaagcgaagtcaccggcgtatctaggatccagctttgcattccttgcaccagctggtgtcgtgatcagtaagatggggtatccgtatgtactgggaggatttgtagcagttggattctgcggatgtatcctgtcctttattatttacaaatgtggaacgaagtggatcgatattgtgcttccaccggcagctatggggccggttgttgcgctgatcggactggaattatcaagttctgccgcaagtaacgcaggcttgttggaggataagatcgatccaaagaatgtacttgtatttgcagtgacgctgggggttgcggtatttggaaatattttattcagaggatttttatcagttatcccgatcctgatcgcagtagtcgcaggatatctgacagcgttggcatgcggaatcctggattttacacaggtagtagaagcttcatggtttgcaatcccgaattttcaggcgccaaagttcgatatgggtgcaatccttatgatccttccggtactgttggttatcacatccgagcatatcggacatcaggttgtaacaagcaaaattatcggaagagatttgttaacagacccgggacttcacagatccctgttcggggataatttctcgacaatggtatccggactgatcggatcagtaccgacaactacgtatggagagaatatcggagttatggcagtgacaaaagtatacagcgttcgtgtaatcggcggggctgcagtcctgtctattatctgttcatttgttgggaaattatcgatgatgatccagacaattccgggaccggttatcggaggaatctcgttccttttatatggtatgatcggagcatctggtcttcgtattctggtagactccagagtagattatggaagatctagaaacctgatgttaacatccattgtatttgtaaccggtctgtccggaatatctgtgaatatcggaaccgtgtcattaacaggaatggttctggcatgtgttgttgccatggcacttagcctgatattctatatcttagataaattaaagcttaccaatgatcggaaagcgtaaggtcttctttaagaaagtgtaatataaaaattacccgtttcacaaaaatcagtgagacgggtaatttttatgtagaatctttcttgagaatatgatggtatcttggtataataccattaagaagagacggaaatggagacaggaatatgggaaatgaaatgaatgaactcagatatctggatctgaagaatgcattatgtgaaaaaatatataaaggcatatataaggatggaaaaaagattccatcggagagacagttatctacagactatgaagtgagccgtattacggtgagaaaaacactggagcttatggaaaaggaaaatctgattgtccgcgaagtgggaaatggaacacgggtgacattgaaaaattatggaaatgcaaatcctttggatgttgtggcgcttacggcaccatcgaggaatcctttttttgcaaattttattgcagaatttcaaaagcaggcatgggaaaaaaatacactattactatatgtagaggtaccggaaagagcaacgttggaagattgtctgtaccgtctgtatacgagaaatatcagaaacgtggtagtatggcaggatgaccagacagtagacagagagaaacttttgcgtttgcggagtattggaatgaatatggtcttttttgatgcagatgatgcactgccgtatgcagatgctgtgtttctggacaatgtagatgccgtgaagagtctgttgaaaagcgtagaatttccgggagaaaattatctgtatgtgggatgggataaccggagcatcagtaatgtaagaaaaagggaagctgcatttacggagaattgtccggatggcggtgtggtaagaataccatggagaagagacaggaaaatcgaagaagaatcggtaaaacgagtaaaaaaagagattcagaagatgccacaggggatgatcgtctgtggggcaggtgagattgcacagcggatattggaatccttatgggagatgatgagtcaggagaaaaaatatatcatcggtacgatcgatgatttcgatggatcggatcgctatccggtaaaggtatgtgtgcaaaatcttagagagtcggcaagaaagatatatcagagattagaagaacagtcagaactcggaagcggttggaaagcagagagctatctcatcagagggaaaatcataaaataaagagttcacaaatatagttcatgaaaaagaaaaggatttgatggatgattttggagaaatatgagacctcgatctaagaaataaaacggcaaaattatcttgacaattttagccttgtggatgataatataagtacattattaaaagatttaataaagtctaggaggaacggtttcatggatggaaaaatgaaagttgcagtgatgaacggaattgggaaaatgggctttgaagaacgtgatatcccaacaccaaaggcagacgaagtattagtaaaactggattatgtaggaatctgcggttccgatcttcattattatgagacaggggcaatcggagattatgtggttgagccgccatttgtactaggacatgaacctgggggcgttgtggtagaagtaggagaagatgtaacacatctgaaagttggcgacagagttgcactggaaccgggaaaaacctgcggacactgtgaattctgtaaggaaggaaaatataatctgtgtccggatgttgtattctttgcaacaccaccggttgatggagtatttcaggagtatgtagcacatgaggcaggactttgcttcaaactgccagataatgtaagcacattggaaggagctttgatcgaacctctggctgttggattccatgcagcaatccagggcgatgcacatcttggacagaaagcagttgttatgggagccggatgtatcggacttgtatcactgatggcattaaaagcaagaggtgtatcggaagtatacgttgttgatatcatggataagcgtctggaaaaagcaatggaacttggagcaactggtgtcattaacggagccaaagaagatgtgatcgcaaaagtgagagaactgacaggcggtcttggaacagatattgtaatcgagacagcaggtacacagattacaacgtcacaggctatacatattgcgaagaagggatctacaattgttctggttggatacagcaaaacaggagaacttacacttcctgtaagtcttgcactggataaagaactgacattcaagacagtattccgttatcgtcatatttatccacttgcaatcgatgcggttgcttccggaaaagtgaatcttaagggaatcgttacagacatcttcccattagatgaagcacagaaagctatggattatagtgtgaataataaagcagatattgtaaaagcagtgattcagatcaatccagatgctgaagcgtagatcatatcagcagaaaacgtcagtttatatgcgaaagttattggtgtaaagaaaaaagaatataaaaaccagaaaaagccacacaatgctattgacattgtgtggcttttttagtattatcaacttaaaaacaacaagaaacaagataaaacaaagaaaaacaaagatttaacaaacaaaaaaacacaatagaacagaacacgaattcaggtaaaaggaggagtgagagagatagtcatgatagcaatagaaaggcgaaacggtatattggaaaaactgcaggaagataagaaagttgttgtcggagaactcagccagttatataaagtatctgaagagacgattcgaagagatctggaacgtttggaaaaagaaggtttatgtacaaagagttatggcggggctgtgctcaatgagaataacaatgtggagatgccgttcaacgtcagaaagaaaagcaatgcaacaggaaaacagaaaattgcagagttgatagccggtatggtagaagacggagaacacattttactggatgcaagtaccactgccgtatacattgcaaaagcactgaagagtaagagaaatcttacagtcgttaccaattctatagaagttctgatagaggtatcagatatgacggactggaatgtgatttctcttggaggaagtttaaaagaaggatttctcgcagccatcggagcagcaacaatcacaggagtgaaagaatataaagtggaaaaatccatcgcatcctgcaaagcatttgacccggaggaaggattttatgataccggagatgagtttgcaagaaccaaacgggcgatgattgaacgtggcgatgtgaagattatggcgatcgattctaccaaatttgaaaaatctgcatttgccaaagtgatggacacagaaggtatagatgtgatcatcacagacagaaaaccacagaaggcagtattgaaatcttgtgaagaaaagggaattaaatgtatatactcggaaaaatagaggagtttcttctatattaatatgaacactataaataatttaaaagaatatcaggaggataaagaaaatggcattagttacttcaaaagaaatgttaacaaaagcaaggaaaggtggatatgcggtaggagcattcaacgcagagaatatggagatggtcaaagcaattattgcagcagcagaagaactgaaagcgcctgttatgatccagaccaccccttctactgtaaaatacggaacaagtgctacatatgcagcgattgtaaaagcagaagctgagaaagcaagcgtaccggtatgcatgcacttggatcacggcagcagttatgaacttgcagaagaatgtatcggaaatggatatacatctgttatgatcgacggatcaaaagaagattttgaaaataacattgccgtttccaaaaaagtcgtagaaatggcacatgcaaaaggtattccggtagaagccgaacttggaaaagttggcggaaaagaagatgatctggtagcagaagctgatacaaatacagatgtaaatgaggcaattgaattcgtggaaagaacaggcgtagattcgctggcaattgcaattggaactgcacatggattttatgtgggaacgcctgtacttgataaagaacgtctttctgaaatcgcaaaagttgtatcaattccacttgtacttcacggagcatccggaatcagcgatgaagatgttgcggactgtgtaagccgtggaatttcaaaagtaaactttgcaacagagctgcgtgtggcatttacagatgcatgtaagaaattatacatagagaaaccagaaacatttgatccaaaggcatatggaaaagttggtatggcagcagttaaaaaactggttatgaaccgtatgagagtatgtgggtgtgacgggaaagcagagtgattctttatccggagaatacaaaaaggaggttcctatgcgggaattattattgggagttgatatcggaaccagtgcctgcaaggttgcggtatttaataaacagggagaggtaatcgccagcggaaatggtggttatcaggtatattacccacatccgggatgggcagaacagaatccggatgaatggtggagcgcggtatgcagcgcgattggagatgtcctgaaaaagggtaatgttaagccggaagaaatcaaaggaatcggagtggatggacagagttggtcggctattccaattgataaagatggaaatgtattaacgaatacaccaatctggatggataccagagcgcagtcgatctgtgacagattaaatgtagagattggtgcagataacattttccaggtggcaggaaattccatgcagccatcctattctacagcaaagattctgtggtataaggaaaatatgccggaggtatatgcgaatacatacaagatcttacagtccaacgcattcattgtataccgttttacaggaatctgttcacaggataaatctcaaggatatggtctccactgctttgatatgagaactggtacatggaatatggagatgtgtaagaagcttgggataccggaaagttttctgtcagacatttacgaatgttcggaaatcgtaggcggagtcagtgaaaaagctgcaaaagagaccggacttttagaaggaacaccggttgttgccggagcactggatgcggcatgcggaacacttggttccggagtaatccatccgggagagacacaggaacagggcggtcaagcaggtggaatgagtatctgtctagatgagtatgctgcggatccaagactgatcctgagttatcatgcagttccgaatcagtggatcttacagggcggaaccgtcggaggcggcggagttatgcgctggatcgaaaaggaacttggggattatgagagaagtatcgcaaaagaatgtggaaaatcctcacttgttcagtttaatgaactggcagagaaggtgccggcaggaagtgacgggctgatcttccttccgtatatgtccggggagcgttcaccaatctgggatccgaatgcaaaaggggtatattacggacttgatttcagtaagaccaaaggacatctgatccgtgcggcaatggaaggtgtagcatattcattaaagcataacctggatatcggagaaaagacaggagcgaaagtggaagaactgcttgcaatgggtggatctgcaaactcacttctgtggacacagatcaaatctgacgttacaggaaagccgattaccgtaccgtcatccgatacagctacgacacttggcgcagtcatgcttgctggagttggaatcggaatgtataaagattttgaagaagctgtaaagattacagtgaaaaagactcgccatcacgagcctgatatggaaaaacatgcaatttaccagaagaattatgagacttatctggaaatctatgagaatttaaaagagaccatgaagaaaacaggaggaatgtaaaagtgaaagcaggagtcgtacacgcaagagaagacattagatatgaagaaatcgagaaaccggtaccaaaaaaagggcaggtactgatcaaagtaaaatataccggaatctgtggatcagatgttccacgtgtgaatggagatgcatgccatttcttcccgaatgtgttgggacatgaattctcgggaacagttgaagaggtaggagaaggcgtaacatctgtaaaaccaggtgacagagttgccggtgtaccacttgtaccttgtatggaatgtgaagactgtcagaaggggaactattctctgtgcaaacactatagcttcatcggttccagagagttcggaagctttgcagagtatgtagttgtaccggaaaagaatgctgtaaaatttgaagacagcgtaagctttgaacagggtgcattcttcgagcctgccacagtagcacttcacggactggaaagagtagactttaaaggcggaaagaccgtagccatccttggaggaggaacaatcggaatgttcgttatgcagtgggctaagatcttcggagcaaaagaagttgttgtatttgatatctctgatgaacgtctggaattaggaaaacgtcttggagcaacagccggaattaacacactggaagaagacttcatggataaagctatggcacttaccggtggtaaaggctatgattatgtgtatgagacagcaggaaattctattacaattaagatggcattccagttagctgccaacaaagcacaggtatgctgcgttggaactcctacaaaagaagttaccttctctgtaaaagagtgggagaacttaaaccgtaaagaatttatcctgacaggatcatggatgtcatacagtgcaccattcccgggacatgaatgggaattagtagcacactacttcaagacaggagaactgaagtttgacgattccttcatcttcaagacgattccgcttagcgaaatcgcaagtgcatttgagatgtacaagacaagaggactggtaaaaggtaagatcttaatcgacagcgaagcataggaggcaaagtgcgatgatattaaccgttacgttgaatgcagcgattgataaaagatatgtagtaaaagaattccaggtaggagaagttaaccgtgtagcagagtgtacttatacacctggtggaaaaggactgaatgtatcaaagcctgcatctatcgcaggagcagaagtggtagcaaccggattcgcaggtggacatgcaggaaattatatcgtagattccctgaaaccattcggcatcaagagtgaattctatcacatggatgcagagagccgttcctgcatcaatatctgggacgaaaagaaccatgtacagacagaattcctagagcctggatttaccgtatccgcagaagactttgaaggattctgcgaaaaattcaagacattagtaccaaaagctgatgtagtagcaatgtccggaagtgtaccaaagggactggacggaactgcgtatcagaaactggtatcgattgtaaaagaggcaggtaagaaggtcattcttgatacgagcggaaaacttctggagatgggtatcgaggcaaaaccaacgatggtaaagccgaacattgatgaaatccgtatgctgaccggaagccattgtgataccagggaagaactgatcgaagcaggaaagaagatccatgaagccggtatcgagatcgtagtcatctcacttggagcagacggatcactcctgatctgcgaagacggggtatatcaggcaatcgttccaagaatcgatgcggtcaataccgtaggatgcggagactccatgatcgcaggattcgcactcggattcgaaaggagattaagtgtgcaggagacattaaggcttgcaagtgcaatctcagcctcggcagcattaagagaagagaccggattcttcgtaaaagaagatatggagcgaatcttaccgcaaattgagattaagagactataaaattatactaaaacgagcaatatcgtatgagaactcttctgcttagagatacgatattgctctgttttttattgttcgggcatcctaagcggtgaattaaacatccatttcttcaagatacctcacatgttctatcgctcccagatgatttctttgaagtgcaagcacctcatccaatccgtcacgggctttctcataatctccaagtccgatcgcactaagtgccatcagatacttgcaatcaatcgtattacgaagctgaatatcactagtattgggcggtgaaaagtatggactgaatatcagtatgaccagaatggtgtattttgtgccggtgccggaagagattaagggaagaatgcaaaagacgcagaagatatttgcggcaatgcagaatctgatgaaagacggtatgagttatcaggcgtattttcggaaagtgcaggaattatatgcaaaagaaggatgcccggaggaatggaagatgcaccatcagggcggaccgaccggatatggctgcagggaatttacagtaacaccagagacgaaaggtgtaattaagaagaatcaagcatatgcatggaatccaacaattgcagggacaaagtgcgaggagactacatttcttacggataagggtgtcgggatatttaccagaacgaaagcatggccatgtactgtgatagagacagaatatgggagctgttcggtggcggatatcttatatataaagaatgaataaaactacaaaaacaggtgatacagaaaagaaagaggttatactcacagaaactgtgtcatctgtttttttgaagtagataattataattttaaaactgtatatacaaatggcacaaaagtgtgcaaattaagtgaaaaaaattgtgaaaaatatttgtattcttttttgtaacatgatataatatagatgttataaaaacacttaaataaaatacttaataaagtagagggcagaaattatgaaaagaagcacgaacagcgtagaagtgaaaagacagaatagaaaccgtgtattcagatatgtgaacggacaggcagagacgagtatgccggagatttctgctgcattagatattagtggaccgacggttcttacaattgtgaatgaactgaaagaagaaggtgtgctaaaggaagccggggagttaaaatcaacgggaggaagaaaggcaaaagcaattgctgcggtaaaagatataaaatacgcagtcggaattgatctgacggcaaaccatataagtattacgtatacagatttgtcagaaaaggcattaaaacatgtaaggatcagaaagagttttgaatatacgaatgaatatctggatgcacttgctgtatttaccagacaatttatagaagaaaatgcaataccggaagataagatattgggaatcggaatatcgatgccttgtattatagataagaaagaacagcttattacatattccaacgcactggatatttataatgtatcctgcagtgaatggaaagaacattttaaatacccggcagttcttcttaatgatgcgaattgtgcagcgattgcagaaagtgctgagcatgtgaattgtggtaatatggtatatcttatgctgagtaatactgttggtggtgcggtgctgtttgaaaacagcaatgtaatcatgacggcaggaaatgaacttgaggctgttgatatgtatcggggagataactggcggagtgcagaatttgggcatatggtaatccatccgggtggaagaacctgctattgtggaaaaaaaggatgtttggatgcgtattgttcggcactccggcttgcagatcttacagaaggaaaattggagatattttttgaaaagcttgaagagggaaatgcagagtatgaaaagatatgggatgaatatctggataatttagcaatagcagtggataatctcaggatgtgctttgattgtgaagtggtcctgggtggatatgtaggtaatctgattggaccatatgtaccaagattacgtcagatggtggcggaaaagaacttgtttggtcatgatggaaattatgtaagagcttgtgattacagggcggaggcatctgcacttggagctgcgattaaattaatagaaaactatatacagacaatatagacaaatgttaaataaataacattattaaaactatacaaaatacacatacaaaatttagtcgatattgcatattgcacaaacaaaagaacaagtattataataataccaacaaagatatgcaaagcgcttttgtaaaagtgatttacaaaagagttatgcagaatcaaaaccaacagacacggctaacaaccggaaggagggcaacatgggaattattgagaacatgagacttgacgggaaagcaatttacgtaacaggggctgcgagcggaatcggaaaatgtgcagccatggcatttgcagaagcaggggcagatgtagcaatcgtagatattaatcttgaaggggctcagaaagtagcagatgagattgcagaaaagacaggttctaagacaatcgcaattgaatgtgatgttacaaagcaggatcaggttgaagcaatggtagctaaagtggttgatacatatggaaaacttgatgcatgttataacaatgccggaatcgcagtaaatgcaccagctgaggagatgacacttgctcagtggcagaaagtaattgatatcaatctgacaggcgttttcctttgtgcaacagcagcaggaagagtaatgttaaaacagggttatggttccatcattaatacagcttctatgtcaggacatattgtaaatgttccgcagccacagtgtggatacaatgcgtcaaaagcaggagtaagtcttctgacaaaatcacttgctgtagaatgggcaaagaaaggtgtcagagtcaactgcataagcccgggatacattggaacagatctgatcatgtcaagagatgatctgaaaccactgattgggcagtggaatgcaatggctcctatgggacgtcttggaaaaccggaagaattacagtcaattctggtatatcttgcaggagacacaagtacatttacaaccggatcagatatcatcgtagatggagcatttacatgcttctaaattgaccggttatatcattataagatagctaatagcaacggctatgcgaataaaatttattaattttaaggaggacaatctatgaaaaagaaaatcgtaagtatcttactgtgcgtaacgatggtagcagccatggcagttggatgcggaagcaaaggcggaggatcagacagcaagtcagaaagcggagattccaaagacaaaaagtacaaagtcggaattacaattcagtcattaagcaatgcgtactgggcaggagttatgggaaaactcgaagaacagttaaaggacaaaggctgggattatacattgatcgattgcgaagacaactctgctacacaggttagccagatcgagaacttcattacatcgggatgtgacctgatcatggttcacccttctgatgcaaaagcagtagagaacatctgtaaagaagcacttgatgctgatattaaagtaatgtgctgggatgacccgatggaaaacacaacggctaactgggtactggacaatacagagcttggtaaagagattggtaaaacagcagctgaatttatcaacgataaatttacagcagatgataaagcacaggttacagttatcggatatccttcaacaaaggttctgaaagaaagagctgatggtatcaaagaaggtctgaaagaaaattgcaaagacaattatgaagtgatcgcagaagttgatggtctggaagcaccggaagcacagagcaacgtagagtctgtactttctgcacatccagatgctaatgtattcgttggagtcggagctggtgctatgatcggttcgaatgaagctcttcttcagaaatacggaaaaggaaaaattccagagaacgtaggtgttattacaacagacgttacagagcagcagctgaattccctgaaagctggaaatgaagcagtaagatctatcgttggatttgaaggatctaacgaagatacagcaaaagcttgtatgaaaatgtatgaaagaatcttaagcggtgagaaatttgaaggtgatgatcacaacgtttacagaacaatcaaacctatcacaacagataatattgatgagatcttaaaaggaatgtaaaacagtcataaaactgaaacagattaaaaaggaggcggcattacgccgcctctgttaattagtagaatcacgggggatgaacatgagcgaagaatatgtattacagttacagcatataagaaaagaatacccgggtgttgtagcgttgaaggacgttacgttggaattaaagccaggcgagattctggctctgattggagaaaatggagctggaaaatctacattgattaagtgttgctcaggagcggttattccaacttctggaaagattatagtaaatggcaaagagttttctagcatgacaccacagttggcatcggaaaatggtattgcaattatttatcaggaatttaataatgtgaaggaactgtcagcagcagaaaacttattcctgggaagacctatccgtaaaggaatagtcattgataaaaaagcaatggaagaagaggcggcaaaagcatttgaagctcttcatattaagattgacccgaaggcactgatgaagaacctgacggttggatatcagcagatggttgaaattgcaaaagcagttcagcagaatgcaaaaatactgattatggatgaaccttctgcgcctttgacaagtgcagaagttgagagtatgtttgaagtagtagaaagacttcgtaaagaaggggtttctattatttacatatctcatagattggaagaaatatatcgtctgtcagaccgtattctggttatgcgtgacggagaatatgtaaagacattgatcacaaaggacagtgaagtccaggaattgattaaattgatggtaggacgtgaacttacacaaagttatccacctagaaaagattgtgttaagaaagatgaagttgttcttgaattacaaaatgtaacaggtaacggagatacggatatcagcttaaagattcataaaggtgagattcttggacttggtggactggtcggagccggaagaacagaacttgcagagatgatattcggggcagtcagaaaaaaatcaggaaaaatgatttttaatggtaaggagatagatccgaagagcccgagagaagcgattaatcttggaattgctttggtgccggaagacagaaaacgtcatggtgctatgttgggtatttctattaagaataatattaatatgccaatctatgagcgcaattccaaactcagcgttataaacaataagcaggaacaggaaattgcagaaaaatataaagaaaatatggcaattaagactccttccctgaatcagctggttaaaaatttaagtggtggtaatcagcagaaggttatccttggaaggtggatggcagcagattcggaattgattatctttgatgaaccaacacgaggaattgatgttggagcaaaatatgagatttataaattgatgaacgatcttgttgagaatcagggaaagacaattttaatgatttcttcagagatggaagagttgatgggtatgtctgacagaattgtggttctttcagaaggaaacatgacaggagaactttcaaaagatgagttcacccaggaagtaattatgacatatgcatccgcagcaagagataaataggcataggaaggggttagacaaatgaaagaaaacaaagtatcaagagttttaaaagaccaggctatctggttagtatttatcgttcttgtaattgcatttacaattgcaaatccaagattcattacaatgagtaacttattaattatgctgcgtcaggtcgctgtatggggaattgcttctgtaggtatgatgtttgttatcttgctgggtgacatcgaccttggtacaggatctgttattacattcgttaatattttatgtgcaaaactgatggttgagttcggtgttaatatgtatcttgcagtactgatttcgttactggcatctacactgattggtcttttgaatggtttcatggtagcgacaatcggtatcccggcattgatcgcaacatttgcgacacaaacagcattttccggtattgcattgattatgtgtaatggacagccaatcaatggattccctgaaaaattctctgtatttggtgcaggatgggttggaccggtacctattccggtaattattatgattatctgctttatcattggagcatttattctgaataagacatattttggacgttatttctatgcagtaggtggtaacattgaagctgcaagactttctggtatccgtacaggaagagttaaatatctggtatttgcattatcaggattttttgcaggacttgccggtattgtacttttgtcacgaacaaattccggtatgggtaatgcaggacttggctacgaattcaaagttattacctgcgttgtccttggaggtgtgtctgtagcaggtggttccggtaaaatgtctggtgttgtagctggtacatttattattggggcattgaataatggtatggtgcttatgaatatcaatacctggattcaggatatcgtacttggtatcgtacttgtccttgctgttggttttgactgtatccagaagaagagacaggctaactaataataaagctgaaaaagatattaaaatcccggtaaaagtttattttaccgggattttttgctaaaatatttttgctaaaatattttcgttaaatactttagtagacaaggggaagagttttgaagaaaagtcagttaatatatcaatatatcagggaacagggagcagtatcaaagcaggatattgtgatcggattagggctgagtcttccgacgatcacgcagaatttaaataatctggcggagttgggattgattgatacgtcaaaaaaaatatcaaatacaggtgggagaaatgcgaccgcttattcctacatagaaaaagccagatatgcagtcggcttgtatttaaacaggcatcatattaattgtgtggcagtagatttatccggtaatgttatcagtctgatcagggtcagggagaattttgatttgaatgacgataattatctgagaaagattggagagacggtagaagaagtcaaaaaggatactggtctttcggatgacagatttctcggagtcgggattgcagttcagggattgatcagtgatgatggtgaaagggttacttacgggcttacgcttaatttcacaggagtgaccagagcagatattgcgaaatatattccatatcataaccggctgttccatgattcggcagcagcaggttatgcggaagtatgggacagaaatgacctggatgatgcattctatcttagtcttagcaacagtgtaggtggagctgtgattgttgctaataaaatatttgagggagaacgcaggaaaagcggtgaaatcggacacatgacgattattccgaaagccggagacagatgctattgtggccaaaggggttgttttgacacagtgtgcagagcaaatgtgcttgcagaatatgcggatggtgatctggaaaaattctttgaattattagaaacgaaggatctcggagcaaggcgccattggaacagatatttagaatatttgtcaataggtattcacaatatacgtatgttatatgatacgaaaattgtaatcggcggttatgtaggggcatatatagagaagtatatggaagatttgtgtgccagggtagatgccagagattcatttaaggaaaaatcagaaaggtatcttgttccttctaaatataagaaagaaccgacaggagtgggagcagcaatccatatgattgatgagttttttgagataatttaagttaaaatattgatagaataatggtatcgtgctataatgccattaaaagaagcgagttaaaaattaaactatggaggtacaatatgaaagcggcagtatattacggaaaacataatctggtagtagaagatgttccggtaagggaactgaaagacaatgaagtgttgattcaggtaaagtattgtggagtatgtggaacggatgtgcacatttttaatggtgatggaggatcttttgaagttacaccgccgttgattccggggcatgagttttcgggagttgtaaaaaaaatcggagctaatgtaaatagaattaaagtgggggaccgtgtgagcggtgacccgaatgatatgtgtggggaatgttatttctgtaaaaatgctatgcagcatttttgtacagataatattggtgtgggtacaactgtagatggaggatttgcagaatatgttattatgcatgaaaaacagttgtatacattttcggatgatctgagttttatcgaggctgcaatggcagaaccagtttcctgctgcttgcatggaatagatctctgtcatattaaatccggtgatacggtgcttgttataggcggaggaccgattggaatgatcatgttgcagcttgcaaagaatgaaggtgcaacaaagctgatcctgtccgaaccggtagaagaaaaacgtgaacttgcattaaaattaggcgcaacaaaagtaatcgatccaataaacgaagatgttcaggcggtgttggatgaatatacaccgaatgtaactgttgtaattgagtgtgtgggaaatatacatacacaggaagatgcagtgaaatttgccggtaagggtgcgacagtaatgttttttggtcttgcttctccagaggatagtttcccactaaagccggatgatgtgtttaagaaagaattgcatattacatcatcatttatcaatccttatacgtacgagagagcaatacaggttctggagtcaaagacattacgtttggaggacttgatcacaaatattgtaccattggatgatattgcagatgtatttacaaagcctgaatacagaagagccggaaaggtcatgataaagattgcagattaagcagttgagaatgtaaaaaaacaaggggcggaactattatatattccgtcccttatattagaaaataaatggtactactcaacaataccaaaaggagagcagttatgaattattatcttggtgtggatgtaggaacatccagcgtgaaatcattattgatggacagcgggggaaagacagtcggaacttctcagattgggtatgacattattaaagaaaagttacaatatgcagaacaggatatggagaagttatgggaggcaacaaaagagacgattacagatcttgtgaagagatatccggaggaatcagctaagattcatgggatcagttattccggacagatgcacggactggttatgataggtgcagacggcaagctgattcgcaatgcaatcatctgggcagaccagagatcagaaaaagagatccagaagatatacgacatcacaggaaaggatacatatcgtggaaccgtgctgaattcacttagtacaggattcttgatctcctcactgatgtgggtgaaagaacatgagccggagaattttgaaaagatccgttatgtagtcttcccgaaagattatatccgttataagatgtgcggagagatcggcacggacatgtcggatgcgtcaagtggtgcaatattcgatacaaagaagcgtgactgggcatgggggctgatagagaaacttcagatgccaaaagaaatcttcccggaatgttatgaagcatatgaagcagcgggaacagttaataaagaatgtgcagaacagaccggattaaaagaaggaatcaagatcgcctatggcggtggcgatactctgatgcagggcgtgggtaacggaattatccggccgggcgtacttgcagcgaacatcggaacgtcctgtcagatctcgggaggatttaacgaaccattatatgatgaaaaattccggaccaatacattctgtcatgtgaaagaagacttatggatgctgatgggagcacacttaagcggcggtgttgcgctgaagtggctgatgaacaacattctggagatgggatcttatgatgagatgacctcacttgcggcgactgtacctgcaggaagcgagggactggtattccttccgtatctgagtggcgagagaacgccatataatgatccgaacgcaaaaggcatttactttggaatgacactgaaacatgaaagagcgcatatgatccggagcacgatggaaggaattgtattcggacttcggacatcgatagaaatatttaaagacctcggaattgaatatcacaaaattatagcatccggtggaggggcaagaggaaagctttttctggagatgcaggcagatatctttgattgcgagatctatacaaatcagggaaatgaacaggcatgcatcggagctgcgataacagcagcaattgcggccggagaattcggaaactatgaggaagcctgcgataaactggtacatatgaaagatacaattgtaacaccaaaccatgagaaccagaaatactatgaagaacagttcgcaatattccgtgagttatatggacataacgcagatctgttcaggttatagtgagactaactattaagaaaggacagatgacagatgaagatatttcagaaaggattcaattactcccaggacggagatggaaacagactggtatatcatatgcaaggctgtaatctgaagtgtccatggtgtgcgaacccggaggggatgcagtgtaaaggaacgatcgtatcagatccggagtggattttggaaagcatctgtccgcatggagcgatcagtggaacaaaagtagacaggaccatctgtgtaggatgtaaaaatcatgagtgcatcacagaacatgatacaaaggggatgtatctgtcttaccagaattatacggttgacgagatcgtagaagaagtcttgaataacgaaatgatgttttacgatggcggcggagttacatttaccggaggggaagtaacaatgcagtttgaagaacttcttgagtcattgaaaaaactgaaagaacacagaatcaatacagcaattgagacaaatggaacgcatataaggacagaagaattgttcccatatgttgatcagctgattatggactgtaagttatgtgatccggtaaaacatcagaaatacacaggcggtgcaaatgaagagattatgaaaaatatcaggaaagcagcaaaagatcatccgtattttcatgtaagagttccgttgatcggtggcgtgaacaatgcaacggaagatctagaagcatttgtccgcttttttaaagaaatcaatggagacaatgtaacatttgaagtgctttcttatcacgaattcggtaagaaaaaatgggaagagtgtggatggaaataccgcatgactaaagatgcgtacgtagatcaggaactggtaaaacagttccgtcagatgatcaaagatgcgggacttaaatataagaaaacctaaaggcaaaagaaaggttttcggtaaaagcttcaaaaaggaggagaagcaggatatgaagatcgaaagtattttaaacgcacaggaaattacagaactggcaaaagaaagattcaaagaagaaagggcaaccgatcacctggaaggatggtttcttgcaaaagagatcatgagagagtgcgatgagaagtttaaagaagatgttgatagtatccgtatctcaaagacactggtagaaattgcaaagagaattccactgtggctcagtgattatcatatttttgcgggaacacaggacgatgcatttgcaagatcttatgcactgatcaatcctgcattttcggtagattcatttacaggatactgtgatccggttgctgtatttggtgatattgatccaaatggggatattacacgggaaagaattgatgatctgaaaaaatacaatgaaaatacaaaatttgcacaggcactctgtgcagcttatgatattgcaggcgacaagacaagcgaggcaatcttctttatcgagcaggttaccggacatctgattccagatatgcgaggtgcattaaaagtcggtgtgaaaggattaaaagagcagatcaaagtaaataaagcaaaagaaacagatgaagataagaaggtatattttgatgctatggatattgcactggatgcagcagtgatcattgcaaacagatatgcggatatggcagaagaaaaagcgaaaggactggaagcgaaagataaagagcgctttaaactgatggctgcaacgcttagaaaagtaccggagaacggagcagagaatctgtatgaggcaattcagttatttatcattatgtggcaggtaatgtgcctggagcagacaccgaacccatatgctttctctgttggaaatgcagaccgtatcttcgaaccttacagaagcaaagaagatacaggcagagacatgacagctgcattattaaagcacctgcttgtattctataacgtagcagacagaagctgggcaatttcacagaacctgatcattggcggaaagtccaatacaggagaggatatgacaaacccaacttcgtatgcgctgttagatgcatattatgacatgaaccttccacagccgatcctgtctgtgaaattacataagaatacaccggataaattatatgaaagccttggaagatttttattcacacctggatgcctgacaccgtctttctttaacgatgattccgtatttgagttcttaaaagagaagaatcatgtagaaccacaggatctggaagactactcggtagcaggatgtcaggagcctctaatcatgggtaaagataatggtaatacaaccaacagctggcttaatatggcaaaagttctggaactgtgcataaatgatggaaaatcagaaatctcaggaaagaagtttggcaagagttatgaagaaaacggatgtaagaacgcactggaactgcttcagaatatccgcccaatcttctatgagaacctggaagaatacgtagaccagatggtagaatgtgccaatgcagcctctgaagcaatctctatcttacaggtaccatttctctcaactctaatggatggaataaagaccggcgtagacaccagagatacaaaaacacagggaacaaaatataacggaagcggttgtctgatccatggactgtctgtagtagcagattcatttgcggcaattgatacgctgcttgcagaaagaccggaagatgcagaacgtatggtagaggcacttcgtgataacttcgaacatgatccagagatgcgtcagtatctgatgaaagcaaagaaatatggcaataacatcgcatctgtagataaggatgcagcggaaattgcaggaaaagtaagtgacatggtatgctctaagaagaattatcttggcaatgcattccgtgcagactgggcttcaccgtctactcacctcttgtatggctactgggtaggtgcaacaccggacggaagacttgcaagagaagagcttggatatggtatcgacccattatacggcgaagcgcatcagggactcggattcagaatcatgtctaacatgaaacttccatttgataagatgaatggcggatgtgcatctcaccttggaattaatccaaattacttcaagagtgaaactatggaaggcaaaggaatggaattcaaagacaagatcatggccccgctcttcttcaatcctaagaagacagacggaatctctccattctacctgtatgttaatgtaaccacaccggagatgctaagaaaagtactggcgaatccgaagaaatatgcaccaagcggagtatatattatgagaattcatggaacgtttgtgaatttcctggatctgtcaccggatattcaggaagatattatcaaacgtctggatatggagtctacatcgatgtgatgtgggagtgcaatagtaaattgtgaaaatagataaaaagagaactctgtttttggtgaaaaaagagaaaacagagttctttgttaaatgcgcttgaattttttgaaaaataatattattttaatatatattaaaccacatttaaaaagtattttaaataacgaaaggagatacaattatgagaacaattcaggcgaagccattaacagcagatgcattcagacagtacggaacattctggtctgcagtcgatggagaaggatatggattgggcggaggattttttacattttatccggaccggattgcagtgtcatcagagaaaaggataggtttttcaacactgaaagtgagtaaaccggagaagtatattgtagaggaactggaatatcataagacgacatgggagatgtttatgccgttgaatgatgacgctgttctgcatgtagcaccaaagtccggcggggatgtagtgactgaactgacagaagcgtttattgtaccaaaaggaacgatggtaaaactggatgcggcagtatggcatctggcagctatgcccgtgaatgtagaagaactgcagagtctgattgtattaccggaaggaacctacatgaatgactgtaccaaggtggcattgaatgatgaacagaaatttgaaattgtaatataagatgacaatccaacgatatgtgaataatggaggattgaaggaggagctgcggtaatacagatgacgggaacaaagattgatacaataaagatacggcagttgaaccgggaacagacatttgaatatatcaaaaagaatccgatggcagcaagagccgatgtggcgaaagagctgaacttaagttttccgaccgtgaccagtatcgttacagagttggaagaagcaggactgatccgggctgaaaaaagtacaaccaatacaggcggccggtcatcgatggcgtatagctgcgatgaaaatgcaagatgtgcgattggtatccagttatcggaacgttatatgaaaggacttgttctgaatctgcaggggaatgtaattggaaatgtgattacagaaaagttaaagtttcggtcggatgataattacaggcggaaaataggtgaattatatcaacgtctggtacgggagatgggattaaaagaaggagagatcctgggtgtgggaatcacagtagaagggctgacagataatgagggagaacgtgtgacctgcagttttacggagcaaatgtcagatgtccgaagagaagaacttgcaaagtacattccggttgaaacacggctgtttcatgatatgacggcagctggatacaaccagaagctaaaactcggacagaatgtattctacctgtccttgaacagcagtatcggtggaactgttcttgtgcaggatgaagtctataatgggaatcataaccgggccggtgagatcggacatatgcgtcttgaaaaaaatggaagacgttgttattgcggtaattatggatgttttgatgcgtattgcaatacattgatcctgaaagatgcggcgggaggagaattaaaagatttttttgccgggatcgatcaggggaatcgggaatatgaacgaattcttgacgaatatgtggaaagactcagtgatgcggtattcaatatccgtatgctgtatgatgacacggtgctgatcggcggtgaactgggagaatatgcggactacttcatcgaaaaagtatgggggattctggacagccaggatatctaccgggaagaaagtgcaaaggattatgtaaaagtctgtgaagatggagagaatgtgatcgcgatcggagcagcaatgtattatatcaatcaggcggcagtcagattgtaaaagaatctaagagatcaaggaggaaaaaagatgacagaattagaaatcaaggaacagatgtgtgaagtgggcagacgcgtatataacaaaggcatggtggcggctaatgatggaaacttttccgtaaaattaaacgatcacgaattcttatgcacaccaacaggtgtaagtaaagggttcatgacaccggaattcatctgtaaagtagatgagaatgcgaatgtattagaggctaatgaaggattccgtccctcttcggaaattaagatgcatatgcgtgtttataaagaaagaccagatgtaaaatctgttgtacatgcacatccgatgtatgcaacatcattcgcatgttgtggaatgggtctgacagagaagatcatgccggaagcagtactgtcacttggagaagtaccgcttgcaaaatacggaacaccttctacagacgagattccggatgcagttgcagaatatctggattattatgatgcagtacttctggaaaaccatggagctttgacctattccgattccctgatgaatgcgtatttcaagatggaatcactggagttctatgcaagacttctgtatcaggcaaaaatgcttggcggcccgaaagaacttccggaagaacaggtactgagactttattctatgagaagccagtatggactgacaggaagacatcctgcagacaaactgaaaaaataaccacaaaagagctgaaaaacgggaaagaaaggagcgtacaggatggaaaatcagaatacacattatgttctggcatttgattttggtgcttccagtggaagggcaattctcggcgccctgaaagatgggaaaatagagatgaaagagatccaccgcttttcgaatgatcctgttatcgtaaacggaacgatgtactgggatacactccggcagttctttgagatcaagcagggaattgtcaaagcgaaaaaatatggaaccattgacagtatggggattgatacatggggcgtggattttggactgatcgatgaacatggtgcacttttggaaaatgccgtacattatcgtgatgagcggacacgcggaatggacagaaaagtatttacgaagatcccgaaatcagaactttataatataacaggaaatgaatttaactacttcaatacaatctttcagttaaatgcattgaaagaaaatcgcccatggatgttagaaagagcgaataaattcctctttacaccggatctttttaactatttcctgacaggagaaaagaaagcagagtatacgatggcaacaacgtcctcactcctggatatccggaaaagagagtggtcggaagaagtgatagaacggatcggactgaagaaagaattattcccggagctgatcgcaagtggaagtatcgtcggtcctctgaaaaaagaaatctgtgaagaacttggcgtgaattcgatgaaggttatagctgtagcctctcatgatacacagagtgcatcggcagcagtcccaacgcaggaaaaagattttatctttatcagttgtggtacatggagtctgtatggcacagaactggatgaaccggttattggagaaaaatcacttgagatgaatgtatcgaatgaaggcggttatggaggaaagattaatttccttaagaatctgaccggtctttggatggtgcaggaaagcagaaggcaatggatccgggaaggcaatgaatatagcttcggagaactggagacacaggcaaaagaagtggaattattccagaactttgtggatgccaatgcagaagaatttgtatcatctggcaatatgccgcgcaggattcgtgaatattgtaaacagacgggtcagacagtaccggagacgccgggcgagatcgtatgctgcatcaatcagagtcttgcaatgaaatacagaagggaactggataagatacagtattgcctgaataagaagtatgacacgatccatatgatcggtggaggaatccagagtaaactgctctgccagatgacggctaatgcaaccggctgccgcgtagctgcaggaccagtagaagctactgcatttggaaatattgcagtacagatgatcgcacttggccagatcaaagatatcaaagaagcaagagagatcattgaacgttctgaggcgacctgttattatgaaccgcagaatacagaagagtggagtcaggcatatgcacgttactgtcaggtgacaaaaagacaggaagaagaattagaataaaaaacataataaaaactccggagaagagattgttcaaatcttctccagagttttgctatcccaggggagggatatgtattacttactggagttccgagatggttacatcaccatatacagatttccagtcagcatcaaaatcatctacggctttcagaatatgagcctgtgtcagtgcagctgataagatggaaggatccatggttgctgtctgtgcaccggcaaggaaagcgcggtcaacctggcctgcattcttaaagcttgcgccaagaatctgtgtgtgatatccgtaaagtcctatcatttctgcaaaagaagcaatgacatcatccggatcgattcccatattttccatcctgttaaagtatggtgcgatataatcagctcctgcttccatggcaaggaatccctgctgtttgctgtagattgcggtagcggttacattaacgtcctgttttttgagggttttaatcgctttgataccttctaatgtaacaggaactttgacgcatacctgatcgtctactttgttaaggatcgtctctgcatcacggagcattccgtcagtgtccagtgccgtaacctgaatatgcagagtcttgtccattccgatgatagaacggatctcgttcatatgcgcaaagaaatcaatctttccttctttttttacaatcgatggatttgatgtaacaccggcgattgggaaaatgtctgtatagtaacgaattgcatcaagattagctgtgtctaataaatatttcataagaaacctcctgaaaattaataatatgaaataaataagtgattactgtgcaaccagtatccggattcccttttcggagagaaaagatttttcctcttcggaaatgccggcatcggtaatgagctgataaacatcctgaaaccgtagataagcaacagctccggattgacgaaattttgcagaatcggcaagaatgtaggtgtgatctgcagagtttgtcatttcacgtacagtatcagtacgtgtcagatcttctccggtgaatccgaactctttggaaaagccatcggttccggtaaatattttatctacatgaaacgctttaatagcttgtttggtaagaggaccgaccagggatctgcctttcggctgtaaagtaccgcccaaaagaatgatctggatattactatagtcagcaacgtaatcggcaagatatacggaattggtaataatcgtaatgttctgttttgttttggcaagttcttctgcgaaaagtgcgcaagtcgaaccagattcaatgatcaacgtctcgccgtcctttacaagtgatgcggcagactgtgcaatcttctgcttgttatcgtaatgaaaggccatacggtaattgatatccccgggatcttttagtacagcataaccgcgctctctttttaagattccgcgtccggacagcgtgtctaaatccttgcggattgttactttagatgtatgcagatattctgcaagtgtagatacttcggtcttgccatgttccgtcatatattcaagtaatgcggtatgtcgttcttttgatgtcaaaatgcacacctcctttaagttatgtgatttctacagttgttatattatcactgaaaataacataagtcaataattaaagttacgtacgaaagataaaaagtttcaaaatatttacaaggagatgactatgtggtatagtaatagacagagaaagagaaaaataggagaaggagagcggtgaaatggataaatatttaatcgcacatgatcttggaacatcgggagacaaagcatccttattttcaatagagggaaagctggtaaaaagctatacggcatcttacaaaacgcattattttcataataattatgcagaacaggagacggaagactggtgggaagcaatctgcaggtcaacaaaggaaattgttaaggacatagaacccgaagcagttcttggaatttctttttcgtcgcagatgcaggcgtgtgttgtggtagatgaaaaaggaaatgcactgcgtccggttatgatctgggcggatcagagatccggagaacagatggagaaactgaccgaaaaagtaggagcggaccggatgtacgagattaacggacatcgtccgagtgcaagctacagtatcgagaagctgatgtggatcagggatcatgaaccggaagtgtatcagaatacatataagatgctgctggcaaaagattatattatctgcagactgacaggaaaatttgttacggattattcggaagcttccggaacggatgcattcgaccttaaaggaatggaatggtcggaagaagtgctgagtgctgcagaaattccggcagataagatgcctgaattacatgcatcgacggatgtgatcggtaatttgactgctcatgcagcggaagaattgggacttgccgtgaatacaaaggtagtatgcggagggggagacggaccatgttctgcactgggagccggaagtacggagaatgggcagatgttcctgtcgtatggcacctcggcatggatcgcaggaacttcagatgaagtattcctggacaaagaccgcacattaatctgttttgggcatgtaataccgggaaaatatatgccttgtggtaccatgcaggcagcaggaagctcttattcttatatccgccatgcaatgtgtggagaggaagaagtgaccgcagaaaaagagggggtatctatctatgatgtcatgaaccgtctggtagaacagtcgccggcgggagcgaaaggacttgtatttcttccatatcttgtgggggagagaagtccgagatggaatccggatgcatcgggaagttttctcggaatccggatggagcatgaaaagtgtgattatatccgtgccgtactggaaggggtagccatgaatctgggtataatccttgaaaagcagagggagaacggagaaattcaggagctggtacttaccggaggaggagccaaaggagatacgttgtctcagatactggcagatgtgctgggtgtacgcctgcaccggctggatcaggtggagactgcaacttccgtggcagcagcggttattgcaggtatcggtgtaggtgtgtttaaagatttttctgttgtagatcagtttgtgaaacgggaaaagacatttgttccgcgtgaagaatataagccggtatatgatcatcagaaaaaattgtttgaaaaaggatatgagtgtctgttggattattacaaaatgtctgcagaagaatagaacagaaacggaaagtatgtaagatggatataaagacatacaaagaaaaggaggatatacaacatgaaacatggaatttattacgcttattgggaaagtgaatgggctgctgattacaaatattatgtggaaaaagtagccagacttggatttgatattctggaaatcggtgtaggtccgattgcagattattctcagacagagatcaaagaattaagaaaatgtgcggatgataatggtattattctgacaggcggatatggtccgacatttaatcataatatgggatcctctgatccgaagatcaaagcagaggcgcttgactggtataagcggacgtttgatgtaatgggtgaattggatatgcactggcttggaggtgcactttattcttactggccggttgatttttcaacggtaaataaaccggaagactggaaatacagtgtagagggtgtacgggaacttgctgatgctgcaaaaccatatggaattgatcttggaatggaagttattaacagatttgagacgcacattttgaatacatcagaagaaggtgtggaatttgtaaaagaagtagataaagataatgtgaaagttatgcttgatacattccacatgaatattgaagaggtgagtatcggagacgcaatccgccatgcgggaaatcttctgggacacctgcatacaggcgaatgtaaccgtatggtaccgggaaaaggacgtatgccttggagagaaatcggtgatgcattacaggatattaaatatgacgggaatgtagttatggaaccgtttgtacgtatgggtggtcaggttggatcggatattaagatctggagagatatcagtcgtggggcaagtgaagcagaacttgatgcagatgcaaaacgatcagttgagttccagagatatatgttggattggaaataatctggtgttaaaaaataagtgagaaaaccgatggagtagctgataatagctatttccatcggttttttagactctgacatgcaagagaagcagctggaagatttttttttgttataccgcaggcaattcatcaataatctgctgcaaaactttttcaacagaatccgtaacatgggttgcatatttatcgatcccaggggcggcattagccatagcatagcttgtgccggcggtctgcagcatttccacatcgttatactggtctccgaatacgacacagtcttttgcatcaatatgtaaatgatcgatcagatcttttaatgcacttcctttgttggcggtcgggcagatgaagtctacccagagattgccggaagtaacaaccttgatgtcggatgaaaacatttcttttaagtgtttttcacacgcatcggttccactgtaatcgcagactgcaatcttaaggatcggttccggaatctcagttcttgggtcatcgatgaatttcatattattctggatgacatttaccatgtgattatagaactccggatttttcgaggtgctgtagcagacacgttcgccggagatgatgcagttgtattgtggatattttgcaacttcatccaggatacggtaagcaagatcctgttcaataattcctttggaaatagtctcttcgttgtatatacagagagaaccattctcggctatgtatgcgatatcatcctgaaccggagtgaacagtttgcgcagattcagatactggcgtccgcttgcggctgcgaacatgatcccgtgttctttcagggtgcggatttggtcgaaaacaattggattgacatcatgtgcgccattttgaagtagtgtgccatcaaggtcgctggcgattaatttaaccataaaaaactccttatataaaacatttctgaaaacattgatatttatttcgctactaattataatataaatgagtaaaatatgaaagacaaaggtaggaacagggatatgaagattggaattgcaaatgatcattctgcagtggacatgaaaaatgagattgtagaatatctggaaagtctgggatatgaagtcgtgaactatggaacagattcttatgaaagctgtaattatccggaatttggtgaaaagattggtaatgcagtggcaagcggtgaagtagagcagggaattgcaatctgcggaaccggtgcgggaatctcgctggcagcgaataaagtaaatggaatccgtgcagtagtgtgcagcgatccatatacagcaagaatggcaaaagagcacaacaatgcgaacgtgattgcattcggagcacgtgtgatcggtatcgagactgcaaaatgcatcgtagatgcatggctgaacgccaagtttgaaggcggaagacatgccacaagagtggacatgatcatggacgtggaaaagagaaatcataatttatagaatgcatttttgagatagagacatattatggatatggaggaagagactactgacagtggtctcttttttaggacaaaaaaacgacacgcagagattgtgatctgcatgccgccttttatatcatattatattggagaaatgaaaaaaatgataatatctgttttaagtttatttttttaaaagtttatcttttataacttatttctggtgagctgcttcatactctctgaaagcatctacctttggctgagaagagcatcccggaacgaattcgtttgtcaggaaagcatctgttaattcttctcttaatttgttaccgattgtgaaagctcccatacatgcgatgttggcatcgttgctgagacgggctctcttggctgagtatacatcagaaagtaatgctgcataagcaccttttactttattagctgcgatagaaacaccaagacctgttccacagatcaggattccgcggtcatactcgccggaagcaacagcttctgcaacagcaacagctgtattagcgtagattggatcttcgcttccgaaatctttgatctcgccatatcccttatcttccataaatttgatcagttcctcttttgcctgctgtgcgtttggatcacatccgattgcgattttcatagtgaatatcctccttagatataaaaattaaaagtttttaaatgaattacggtttgctgaaatgtcttctatattaagaagctttattttgcgtcgtgcgttttgatcgcatcgcggatcaaagtgtcgaatttatctgcctgccatgcagcacgtcctgtgaacagtccgtcgatggacggctgaacgatcagatcacatgcattgccaggatttacgcttccgccgtaaagtgccggaatctcatcggctgcatcgccgaagatctcgcgtaaagttactttgatgactttgtgcatctcttctgcgtaatcagcagaagcaggagttccgttgactccgatggaccatacaggttcgtatgctacccagatgttcttggcatcttcttcagatacgccatggaatcctacctttaactgtgtgcggagcacctcagcactgatgccgaattctttctcctctgcagtctcaccgatacataaaagagtcttgaatccgtgttccagtgcgcagagcaccttcttattctcttcgatatccgtctcgccgaatacatgacggcggtcggaatgaccgatcatgacaagtccgatgccggcttcctgtaacatcagaggagaaatctctccggtaaactgtccctgttcttcccagcacatgttctgtgcacctaagcggatgttcttctggtcaatggcttttgaagcactgtccagagttgtataagaaggaataatgaaaagttcgatctcgtccctgcttatatcttttgtaagggattccagttcctgaagataggaaacggtatcttttatgtttttgtacattttcaagttacttccaaaaaaaagttttttactcatgataccctccagtttcgatattttgttttttttgcttgtcttgattatatctctaaaatagaagaaaagcaataataaaagcgaaaataaacgaaagaaaatgaaaataaagtaaaaagtgataaaaccttaacaaactactgaaaaatgcacaaaaactaaaaaataaatctatgcaattgtgataaagttacggaaaagtgataaaaactattgcaaaaacgaaaaaagaaatgtaagatatagacatcgaaacgaaaacaaaaccgaaagaaaaacgaaaaaagaaaggaaagtaaagaattatgagtacacagtatagaccaattacagcaatcacaatgggagatccggcaggtatcggacctgagatcgtagtaggaacaatgttaagtgaagaaatccacgactgctgccgtccgttcgtaatcggaagcattgcaatcatggaaagagctgcaaaggttctcggaaaagaattaaaatacaacaagatcgaagatccatcagaagcaaaatatgaattcggaacagtagatatcattgagacaggtgattacgatacagattctatcgaatggggaaaagttcaggcccttgccggacagatggcagttgactggatcatgaaatccatcgaacttggagaagcaggaaagatcgatgcagtttctacagcaccaatccacaaaggagcaatcaaactgatcggcgtaaaagaacctggacatacagagatctatcagaatgtaacacattctccatatgctctgacaatgttctcctgccacaaattaagagtgttctttgtaagccgacatatgtcactggtagatgcatgtcactacgctacaaaagatgtcattcttgaagatgtcatcaacattgataaagagttaagaaaagtcggaatcgagaatccactgatcgcagttgcaggattaaacccacacaacggagacaacggattattcggacgtgaagagatcgatgagatcgaacctgcagtaaaagctgctcaggaaaaaggaatcaatgcaatcggaccttgcccggctgactctgtattccatattggaaaatccggaaaattcgatgcaatcctttccttatatcatgatcagggacacatcgcatgcaagacattagactttgaaaaatctgtaacacttacattcggacttccatttatcagaagttctgtagaccacggaacagcatttgacattgcaggtaaaggaattgcaggatgcatcagtctgatcgagtctacaaaagtagttgctgaatatgcagcaaaacagcacgagaaaaaagaagcttaatcaaaaagcaataacaaaataataacagaggtacacaaaagggatggcggaacccttttgtgtacggagcatatgtgaacggatagaaagagaggaatgtgccatgcctttgataggagcagttgcggatgacctgacaggagcaacaacgacaggtgtattattagcgagatcgaaagcaagaacagcagtattttttaatgaggaagcagcacaggaagcaagagagacagcgtctctggatgcgatcctgatcagcagcaactcaagaccacttccaagagaggaagcatatgacaaagtaaaatcagctaccaatgcattaaaagcaatgggcgtaaaatacttttcaaaacgtattgatacaactttacgcggcggcgtaggtgtagaagttgatgcaatgttagatcagctgaatgaagatacagtggcagttgtcgtaccggcaatgccgcagtccagaagaatcctggttggcggatattcagtgatcgatggcgtagcattgatcaacacaccggttgcacaggatgtgcgtacaccggtaaaagagaattacataccaagacttcttgcaggccagaccagaagaaaggtcggactggttacattagatcaggttctgaaaggaaaagacggaatcaaggaagcacttacagaagtaagaaatgatggtgcaggtgtcatcattgtagatgcgatcacattggaagatgtagatcggatcgcacaggcttgtatcgatcttgactgggacgtagtcgcagtggatccgggaccgtttacttcaaaacttgcatacagaagagggctcattcaggaagaacagccgaatgtacctcctgcagcaagtgaagaaggaaagactgttctgatcgcagccggaagtgcaacaccggttacgaagaaacagatgcaggtattatgtgaagattccagacatgtcagaatcagtgtagaaccaatcccgctgatcaatggtggagatgaagcgttagatgaagcattcaaagctgtgaacaaagcagtcgagctgatcgaaagcagcaagcagccaagagcaatcctgttcgagacagcacttcacggagaccttttaaatctggatgaagaagataaaaaacgtggatatgcaggcggaatgagtgcaaaccgtatcaatgccggacttggaaccattatctcacaggtactggaacaggtaggaagagaaaaggtagccggtctgtatactacaggtggtgacacgatggtaaatgtatgctatcagcttggagtcgagtgcatcgaagtgatggactacgtaattccacagacagacgtcggaagattagttggaaaatatgacggacttccggtcgtaggaaagggcggacttacaggtaatgacaatacagcctgcgatatcgttgaacgtctgtttaaagaatcggcaagatagcatcgggggataccatcctgatcataaacgttaaacgcatcataaagagaaaaggagagagaaaatgagcgaagaaaaaacacaggttcagaatgaaagaaaagatttagatattctgaataaaatgaaaaaccttccgggaggtctggtaatcatcccattggtaatcgcggttgtacttgcaacatttgtaccacaggtattccagatcggcggatatgtaacagcacttttctatgaaggaaatgcatgtatgatgggattcttcctgatcgtatgtggatctatgatcgacatcaaacaggtaggtatgccgctttacaaaggtgtaattatgacaggtaccaagttcttacttggagttatcgttggtcttattgttggtaagatctgtggaccggaaggattcctcggaatcgcaccatttgtattaattgcaacaattacaaactcaaatggatcactgtacatttccctttcttcacagttcggaaatgcaacagatacaggagctatctcaatcctgtcactgaatgacggaccattcttcacactgatcgctcttggtgcaacaggacttgcaaatatcccgatcaaatccctgatcgcagtattagttccattgcttatcggatttatctggggaaatcttgacaaaggattccgtgatgcctgcaagacagctcagccgatcgtaacattcttcatgaccatttcaattggtgcgaagacagatatcaagacaatcctgacagcaggagcttccggtatcgtacttggactgatctctgcagcaacagcagttatattcttcttcgtgatcaatcttctccttccaaagaaggaaagaaatgcgatgggtgcagctatcggtacaacagccctgaactcagctatgacacctgcagcagttgcagaagctgacccttccatggaaggtatggtaagtatggcaacagcacagtgtgctacagcatctatcattacactgttcctctgcccattcattacagcagcatttgataaatggatgcagaagagacagaaaggtatctatagtccggaaggatgggcttacgataaagtaaaagcaaactaatctgaatcgtaatacaaataacatttcagtccttttatatgtcaaagtataaaaggacttttctaaaaaagaaagaaataaaaatacaggaggttatgctatgagtacaccagagaataagacagaagaaattgtaacgacagaaaatgaagtgacaggaccggcagatgcggtcaaagaaagccggatgacagtgaacatgaccaaggaagcattgtatgatttcctcttgtttcatgcatactccaaattcagtggttttctggtcaatgtccttggacttgcaatcgtttttatgggaatcttttcttatacaacaggaagggtaaatggtgtgggggcagcactttatcttgctgcggcagcactgttcctcggcggtacaccgatccagcttaagatgcgggcaaaaaaacaggttgttataaataaagaatataattcaccggcagagtatacgttttcggaagctggtattatgataaagcagaatggagagagcagaacctatgaatgggatcatatcgagagagcggtagtgacaccgaagacgattggaatctattatgcaccggaatgtgcaatgatccttccgaaacaggattttggagaccagtttgtaccgatatttacaatcatcgccacacagcttggacagagtaaggtgagaatgagataacagtgaaaatatcggaattgttttgaaaaaggaaatggctgtgtgcttgacaatataaacagatagtgtaaacttatttattaagagatagttgcagggaggcagccatggaagaacgtagaaatgagatattaagagaacttgacagaaaaggaaaagtaaaggtaacagatctgagcagggaattcggatgctcggaagtgacgatcaggaatgatatcaaagcgatggatatagaaggattgttgaagcgaacccatggcggagcggtgaagctggaaacggcagaaactgaaagcggaagatattcgacagaatccctctaccggaatgtcgcacagaaaaagcagattgcggaaatggcttatgattttctggaagaccgggatacgatcatcatcgatgatgcatcgaccagtttttaccttgccagggaaatccggaaccatccggaaaaaaggattgcggttgtgaccaattccctgatcaccggaaatgagctggcgggagtcggacatgtggaactctttatgatcggaggctatgtgacgggacatcttgcggcaacaatgggggatgtggcaattcagaatatgtcaaagttccatgtggataaagcatttatcggtgttcacagtattaattttaatgtgggtcttacctccattgcaacgccacagatggaagtgaaaaaagcaatcatgaaagcggcagagaaagtatatgtacttgcagacagcagtaaattcggaggcggctatctgtctgtaatctgtccgacaaatgaagtatataagattattacagatgacggagtttccagagagaatatccggaaagcggaagaactggacgttccattagtgattgcatagtgggagaagattcagatggaaaaacagcagaaagcttataaaggtgtcatagattattttaaacagaagatcatagagggggaacttcgtccgggggagaagctgccgccggagagggatatcgcagaacagttgagcgtaagccgtaattcggtgcgcgaggcaatccgcatcatggatatgacaggagtgatctcttcgcagcagggatcgggaaattatattacctgcgaatttcagaaaagtcttgcggagacgatgacgatgatgtttgctatggatcagatagactacaggcagatcagtcagatacgtcaggcgttggaatgtctggccttttcgcttgcaatagagaacgcaacagatggtcagatagaagaaatggagaaagcagtaaaggaactggatcggagtcaggatgatgtaaagaatgcagcactggataagaaactgcattatacgctcgcacaggcgtcgggcaatatactggtgcaggattttctggaggcatgttccggtgtgatcgattcatttattcacgatatgcgtgcggagattttgcgtacggaagagagaaagaatttgttgaatgaatgtcataaaaagctgatagaagggttgaaagagaaaaataaagcaaaaggcctggaggctttggaacatcattttacgttgatcaatgagattttggaagaacgggaaagatagaaaaacagaagaacatttggcgtgatgtttcatattttatagcagatgggattggttcctgtctgctatattttttgtctgtaaagaggcagaaatgaaggagtccatgattttataaaagatgataggaaaggaacatagctatggcatattcgatcatgttggatgccggacacggcggtacaaaagatccgggagcagtctataaaggaagacaggaaaaggatgataatctgagactggtgctggcaatcggagagatcctgtctgacagaggactggatgtgagatatacgcggacaacggatgtctatgaaaccccttatgagaaagcaatgaaggcaaataatgcaggagtagatctctttatttctattcatagaaattcatttcctgccgataatgaggtggaaggagttgaaagtctgatctatgatctgtcgggactcaaatacaagatggcacaggatatcaatgagcagctcgaaggtgtaggcttcgtgaatctgggcgtgaaagcaagaccggatctggtggttctgaaacgtacaaaaatgccggcgatactggtagaagccggattcctgaattcggacacagataaccgtctgtttgatgataactttgaagatatcgcacaggcaattgcagatgggattctggacacattggaaagtaatgggctgatcaaagaagaaaaagttccagtgtaccgggtgcaggtgggcttgttccggaatcaacgctatgcgaaccggctgcagaatgaacttctggagcaggagtatccggtgtacattgaccggtccggtccgtattacagagtctatgtaggagaatttgataatttaaatgatgcggtacagatggagcgccgtctgaagcgggcaggatatcagactttgatcgtgcaggggaagatttaacatagatttttcattgccggggtattttatttaacatagcctttctatacttgaatcagaaaaagagataagagtaaagattcaaaaaacgggaggcgtttagagatgagatatctgtggaatatgttgaataaagaatttacaatagaaggggctgtcagtgcctttctggtaatcaatatgattggatggatggcagcaacgatgggagcaggaatgctgatctgcaaatttttgggattttctatcacgggtaatttggaaaatctcatgtgtgcaggaatctacggaggattgatcgtaggattggtcgggggcagcttatatctgtacgggttatacaaacaccactccatggaatagaagataaattaaaaagggacttgttttacaaaacagtgtagaacaagtccttttttagttccggaatatacaggaggatatgatggcggatggtatagcaattgacacgaggatcatttcataatattatggaattgctttgggagtgttaagacaacaataaaatgtgtatgtatgaataaaagtaataaaaagatggaggaataaaatggcagatagattacagtttaaagaaaagcttgcgggagtacttgcgcttgcagaagatcagaatggaaagattaccgtagatgaagtggaaaagtattttgaagaggacggactttcgcaggaacagatgaatctggtctgtgattacctgttatcgatgaagatggcggtgatcggttataaacaggccggaggtagggtaaaagaagcggaaaatgaagaacaacagccattaagcccggacgaacagaaatacgtagaagaatatctgcgaagtcttggcgatatgaatgaagagacaccggaagaggtgcgtatggcatattatcttccgaaagtggtagaagaagcggtgagactgcatcatccggaagtgtttatcggtgatatgatccaggaaggaaacattgtactgatgctggcattaaaagagatccggaaggaaaaagatgaagaagagattctggaacaggtacgtgccggaatgctggcatcgttggagtcgcagacagaagtaaagagaagagatcataagatggttgagaaagttacagaacttgatgagacgattaagagtatgaaagaagaatacggacgtaaagtcagcgtggatgaagttgcagacagacttggaatcagcgaggatgagatcgaagatattctgaaacttgccggagaagaagtgaaagatgaagaataaaaggagacggggattaatcctcgtctccttcttcatcttccggttttggttccggcagatataaatgtacactttcaattctgtttttatctaatttttctacaaccagatggatgtcgtcttcggtggtgacgccgtcgccaatctcaggaagccggtccagatgctcgataatgaatccaccgacggaatcatactcttctgaggtcagatcaagatcgagcctgtcatttaagtcatccagattcgtggaaccttctacgatataatcgcgttcaccaacctgtttgataaagtcttcttcgttttcgtcatattcatcatgaatttctccgacgatttcttccaggatatcctctaatgtgatcagtccggaagtttcgccgtattcatccagaacgatggcaatgttaaaagaagcctggcgcatctccacaagtaattcggaaatattcttatattcgtaagtgaaataggcctcgcgcataaagtcgcggatatgaaactctttttctttgtcatataagagaagatctttcatattgatcgtaccgacaacattgtccgttgtatcttcaaaaatcggaagacgtgtgaatttgtcctcgcggaaaatgtcgatcaattcttcgtaggtagcatttacatcggcgaacgtaacatgaactcttggtaccataacatctttcgctttcgcatcgccaagatcaaatacgttatagatcatctctttttcgtcagattcgatgacaccgctttcgtggctgacatctacgatcgtacggagttcggattctgtcatctgtttatttccggcattcggatcgatgtgaagaatgcggagaatgatatccgacagcgtattgatgataaatacaaatggtgtcatgactttgatgtacagatttatggccggagcataacgaagagacatcttttccgcatgcagtgtagccatggtctttggtgtgatctctccgaagagaatgatcagtacagacagaactgcacttgccactgccaccatagacccgccaagattgtaagccagggtggtagtaagggaagcggcggaaagattcaccacattattaccgatcaggattgcactcagcatcttgctggtatcatcggtaatacgcataacggtttttgcccgcttgctgccttcgtcggcaagaccacggatacgcattcggtttaccgttgttaaagctgtctccgcagatgaaaaaaatcctgaaagaatcaataaaatcaatagaataatgagttgtatcgcgacactcgtgtccaattgtataattcactcctttaaaaaataaatacttggcactaatataccgcatttgaggcaaatttgcaagtgtacgttgaatttaccgggcgtttagtgtaagatgtaagtactgtctgagggcaggaattttatgaactgaaaattctgtatgatatagtagcggttggaagaagaacaacctgacaaaaaaggtggagacaagaatgaatcaggaaataggaaagaaattattgagtattttaaaagtggaacaggtaaaaaaggatgaaccgatgaagattcacacaacattccgtgtgggaggtccggcaagctattttgtgacaccagagacggaagaagaaattgcaaaagtgatcgaggtgtgcacacaggaaaatgttccttattatatagtaggaaatggaagtaatcttctggtatccgaccagggatatgaaggagtgatcatccagatatataaacagatgaatcaggtagaaattacggaaaatgagattcacgcacaggcgggcgcattgctttctatgattgctaaccgtgcaatggaagcagaacttacaggttttgaatttgcggcaggaattccgggaacactcggaggagcgtgtgtgatgaatgccggagcatatggcggggagatgaaggatgtactggaaacggtaaacgttcttacccgtgacggggatgtaaaaacgttgacaaaagatgaactggaactcggataccgtaccagtgtgatcgcaaaaaaagactatattgtattaagtgcggtgatcagacttgagaatggaaaaaaagaagagatcaaagccgttatggatgacctgaaggaaaaaagaattacaaagcagccgttggaatatccgagtgcaggaagtacattcaaacgcccggagggatatttcgcgggaaagctgatacaggatgcaggacttcgtggatttcaggtcggaggagcgcaggtgtctgaaaaacattgtggatttgtagtgaataaggatcaggcaacagcagcagatgtgatgaacctgatgaaccaggtgtctgataaggtgtatgaaatgtcaggagtacggctggagccggaagtaaagagactgggagtgttctaagatgagatgtgtgatcgttaccggaatgtccggggctggaaaaagtacagcacttaagatgctggaagatatgggatatttttgtgtagataatctgccggtaccgctgattccgaagatggcagaactgttaagcgtgccggggacggagatcaacaaggctgctcttggagtagatatccggagtggacagaatttttatgaactgaagaagatattaaaagagctggaccggtcaggaacaagatttgagatcctgtatctggaatccagtgatgatgtactgatcaaaagatataaagagacaagacgatttcatcccttatccggaaaagacgggagagtggaagaaggaattaaagaagaaagaaaacggctgaaatttttaagagagcgtgcagattatctgattgacagcagtcatatgctgacaagagagctgcgtgcagaactgtcaaagatttttgtggaaaataaagaatataagaatctgtatatatccgtattgtcatttggattcaaatatggaataccggcagatgcagaccttgtatttgatgtacgttttcttcctaatccgtattatattgatgaactgcgtccgaaaagcgggaatgacaaagaagtccgggagtatgtcatggataatgacaaggcaagaatgttccttgcaaaactgacggatatggtggaattcctgattccgaattatgtacaggaaggtaagacacagctggtgatcgggatcggatgtacaggcggaaagcaccggtcggtaacgttggcgaatgaattatatgaagcattgagtaagaatgataattatggtatccgtatcgaacaccgtgatattggaaaggatgctgtcaccaaagcgaggtagaaagtcagatgtcattctcgggaaaagtaaaagaagaattattggaacattatgccagagcaagacactgtgatattgcggaattgtctgcaattgttcatatgtgcggagcatttggatcgggatacaaaggagtgtgctgtcttaaagtacatacggaaaatctcggggtcgcaagaaaatgctttacattgttggaaaaaacgtttaatataaagaatgatatcgtagtccgcagaaatgcaggaaaagataattacagttattacatttatgcaaaaggtgaagaactaatggcgatccgtgacacgatcgtacaggcagtctgttgtaagagagcatatatcaggggagcatttatagcatcggggtctatgagtgatccaagcaagtcttatcattttgaaattgtctgtaacgatatgcgtcaggcagagcatctgcgggacatgatgaacagtttcgatgtagatgcgaagattgtacagcgtaaaagaacatatgtagtttatcttaaggaaggctcacagattgtagatatactgaatgtgatggaagcccacgtggctttgatggaactggagaatgtccgtatcatgaaagagatgcgtaattctgtgaaccggaaagtaaactgtgagacagctaatattaataaaaccgtatctgctgcagtaaggcagatggaggatattacatatatcagagatcagatcggttttgagaagctgccggagggattaagagacgttgcccttacgcgtctggcatacccggaagcggctttgaaagagcttggtcagctaatggcgaatcctctgggaaaatcaggggtgaatcacaggctcaggaagttaagtgaaatcgcacaacagttaagggaacagcaaggaggagcaagtcgttatgattagaaagcctgttaccattcagaataatatggacatggaagaccgtccggtggctcatctcgtacaggaagcaagccagtatgcgagccaggtatatattgtgatgggaagtaaaaagattaacgcaaagagtattatgggaatgatgagtctgaaacttcagaaaggcgaagatgttacaattgtagcagacggtcaggatgaagatgcagccgtaagtggcgtggcaacatttttaggtgcataacaataatacagggaatatccggatgatgtgagataaaggggccgttgtgatgagagttacaatagcctcttcattattaaattaagaattatatgaaagataagggaggatgcatattttatgaagcgtttgctttttatctacaatccacatgcgggaaaagaacttttaaaaccgaagcttgcagatgtgattgatatctttgtgaaagccggctatgaggttgtggcatatccgacgcaggcgtatcgtgatgcgtataagaaaattaagaaatatgattccagtgaatacgatctgatcgtgtgcagcggaggagacggaacgcttgacgaggtcgtaaccggtatgatgaaacgcgacagggataagcgggagccgatcggatatattccgaccggtacaacaaatgacttcgcaagcagccttcatattccgagaggattactggaggcggcagacaatgcagtaaatggggaagtatttgcctgtgatgccggaagatttaatgatgatatttttgtctatattgcggcattcggactgtttacagatgtatcttaccagacaaaacagtctatgaagaatgttctgggacatctggcatatgtgctggaaggtgcgaaacgtctgttcaatattccttcatataaggtgaaggtgacacatgatgatgaagtgatcgaagatgaattcgtatatggaatggttacaaattccagatccgtcggaggattccgtaatctgatcggaaaacaggtcggattcgatgacggggtttttgaagtgacattgatcaagacacctaagaatccgatcgaattgcaggaaatcatcgctgcattgatgattgagcagatggattccaagtatatgtatacgttcaagagtggacggatcatgttcgaatctatagaggagataccatggacgctggatggggaattcggcggcgaacacgatgaagttgtggtcgagaacctgaataaagagcttcagatcatggttccgggaacgcatgaagaagattaaaaatccctgaattgtagaaaaaactgagaaatttaaaaaaattaaaaaaagtacttgcctttttgcagaatccttgctatactaggcaagtaccaaacgaatggctccgtggtcaagcggtcaagacgctagcctctcacgctggaatcaggggttcgattcccctcggagtcactgagatctgcagattcttctgcagattttttttatcaaagtgttcaaaacaaatctgttaaaagtccattattaatttcatagatataatctataagcaatcttttatataaagaaaaacaatttcaataagcagataataaatgatattatggaagaagtcggaaaggaataggaattatgaaagatcttttgatagtatctcattgcattttgaatcatgcggcaaaggtggaacaggatgaagcggaactggccggagaatataagatccgggaagagttgctgcagcttgttttaaaaaaaaatgtacagctatttcaaatgccctgtccagagtttatcatgtatgggtctcagagatgggggcatgtaaagaatcagtttcaacatccattttatattgaacaatgccggcagattcttgaaccggttttatttcagttgcaagaatatgcgcagcatgtggaaaaattccgcattttggggattgtttcagtagaaggcagtccgaactgtggatatcatcttacctgcgagggagaatggaagggtgagattggaacggatgaaaaaagaatacaggacattcagaagtctctgaaaatgacagaaaaaccgggtgtatatatggaagtactggaagaagaacttcgtaaaaaaaatatgaagattcctattatgacgatgcaggaagcattacagctgctgaaaaactaatggttggagagaagagaggagaacaaaatgaaaaacagaaaagtctatgtaacaactttttgtggtgttgcagtagcaatgaacattgtacttggaattatcacatcggcactgggtatcccgttatatctggatacacttggaaccgtactttctgcggcgattcttggtccggtaccgggtatcatcgtaggagcattgagcaatattattacaggactgatctatagcgtgtcggatatcccattctgtctggtaaatatggcagtcggtctgatcgtaggtcttgtggcaaaaaaatggaaattcggaatcattccggcaataattacaggtgttgcacttagttttatctgcccggcgatcggaacaccaatcggaatctatgtatatggcggactgaatggatcagtttcggatatgctggtgatgtcactggtgcagggtggaaaaacaatttttcaggcttccttcctcagaaatgttgcatcaaacttgatcgataagatcggaacatgtattatcggatatctgcttattaaggcaatgccgatgagatttttggataattttaagaaagaggcataaatctcatatgataaagattgaaaatctggtacataactatacaatatggaaagatgaaaatacaaaaagtgagaagacagtgttggacggaatatcattagatattccgtctggtcagtttgtggcaattttagggccgaatggttccggtaagtctacattagccaggcatttgaatgtattactgcttccggatgaagggacagtatggattgacggaaagaatacacaggcaaaagaaaggctttatgaaatcagaagccgagttggtatggtgtttcagaacccggacaatcagattgttggcaccagtgtagaagaagatgttgcatttggtccggagaataaaaatgtagagccggaaaaaataagaagaattgtagaagatgttttgcggaaagtaaggttgtgggagaagagaaaaactccgccttccaaattatcgggcgggcagaaacagagactggcaacggcggatgcgctggcaggactcccggaatgtctggtgttggatgaaccgacagctatgctggatccctcttcaagaaaagaagtaataaatattgtgaaagaattgaatcaaaaagagggaatgacgattatcctgatcacacatcatacggatgaagtcgtagatgcggatcgtattatattgatgaaggatggaaaaataatcggagatgatattccaaagaaaatatttgcagactgcagcctgttaaaaagagcgaaaatggatattccgccggttgtagaattgggtatgcggctgaaaaagcagaagatcggattggatgaaccggttttacatgaacaggaaatgatcagaaaaattacagaactatatagaagtaaatgcggaggctggaaagatgctgcaaggtaaacatatcacattttcttatcaggatccggcaaaagggaagacagatgtcctggcagatgtttcgtttgaaatcagagagcacgattttataggactgatcggtgcatcaggatcagggaagacaacattgattaagcatctgaacggtctgctgaaggcagaatcgggagaaatcttttttaaaggtaaaaatatatacagtaaaaaatatccgctttcagaattgagaaaaaaagtcggacttgtatttcaatatcccgaacaacagttgtttggcaggacaattttgaaagatgtgatgtatggtccgctgaatctgggaatgagtgaagaagaggccggaaagtcagcaaaggaaagcctggaactggtcggaattccggaagagtattatcagatgagtccgatggagctttcgggaggacagaaaagatgtgctgcaattgcaggtgtattagcgatgcagccggaaatactggtgctggacgaaccggcagcagggcttgatcctgagacgaaacatgaaatatttgagctgttatgcaggataagagagaaacgaaataacgcaattgtactggtatcacaccatatggaagatgtagcgcaatttgctaaccgtgtatgggtaatgcataaaggaaagatcgcgatggacggcactccggaagaagtatattccagagtggaagaactggaagaaatgaacattggaattccgcagatcacacatttgacctattcgctgataaaagaaggcgtgcctttgccacggccggcaatcagtgtggaagaagcagaaaagatgctggcagagattttgaaagaggagaaaccattatgattcgggatattacgattggaagatattatgattcggaatctgtgattcaccggatggatccgaggacaaaattgatgggagttctggtatacattatttcgctgttccttgtgaagaatgtctgctggtatatcggatgtctgatagtaatgcttgttctttataaggctgcgggagttccgtttggatatttgctgaaagggcttcggggaatcctgcttttgctcttttttacgttcctgttccgtatgttgtacacgccggggaatccggtcgtacaggtctggatatttacgataacaaaacaaggaatattaaaggcagtacagatgacagcaaggattgccctgatgatctcgggtgcatctctcctttcttatacttcaactccgaaagaacttgcggatggtttggaaaaagcgttttctggattggaaaaaacagggattcctgtgcatgaaatggcggtcattgtgatgatagcgttcagattcattcccatcatgttagaagaattaaatgttttgatggatgcacaggcagccagaggcgcaaaatttgaagatggcaatatactggaaaaatgtaaaggtgtcatgacgttattgcttccattgtttctgctgacggtacgaaggtcatcggatctggcaatggcaatggaagcccgggggtatacaggaagcggaaaaacttcaagaatgtatccattggtatataaaaaagaagaccgggtgggataccttgcgattttgatatatattagtgttttcataattgcaaggataagttccttgtctttttagaagttatgatatataatgcaagtgaaacaaatttgtcataaagaaacagagatgcttatggcagtaagaattggaggaataacatatgttagtatcagcaaaagaaatgctcgataaggcagtagcaggtcactacgcagtaggacagtttaacatcaataacttagagtggacaaaatctattcttcttacagcagaagagttaaagtcaccagttatcttaggtgtatctgagggtgccggaaaatacatgaccggattcaagactgtagcagctatggttaaagctatgatggaagaacttaacatcacagttccggttgcattacaccttgaccacggaacatacgaaggatgtaaaaaatgtatcgatgcaggattctcttcaatcatgttcgatggatctaaatatccaatcgaagagaatgtggcaaagacaaaagaactgattgctatttgcagagaaaaaggaatgtctatcgaagctgaagtaggatctatcggtggagaagaagacggagttatcggtaaaggtgaatgtgctgatcctaatgaatgtaagatgatcgctgaccttggtgttgatatgctcgcagcaggtatcggtaatatccacggaaaatatcctgcaaattgggaaggattaagttttgagactctggatgctatccagaaactgactggcgatatgccattagttcttcacggaggtacaggaattccggaagatatgatcaagaaagcaatcagtctcggtgttgcaaagatcaacgtaaacacagagtgccagctgtcatttgctgatgctacacgtaaatatattgaagcaggaaaagatctggaaggaaaaggatacgatcctcgtaaactcctgaaaccaggtgctgaagctatccaggcaacagttaaagagaagatggaattgttcggttcagtaggaaaagctgaataatcagtaaattttcacttgccttttttgactggttgagttatactaactggcataggaagaacaaaggcgttccaacgaaagttggagtgccttttttcagtttgcgcgccatgggcgcgctctaacgggtgtaagtcccgaacacgcccaggcgacagcttattaagaatatcacaagcagttgtgtttgtcaactgttattttatcttttttatctctttttgatttaactttttttcagcttaatttcaatcttttcatcttgcaaaaatgctgacttacctgtaggcaagtcagcactttatgttcgctttagataatttgttgtcggtatactcccttgatcaattatctgagtaacatgaatgcaattaatccagctactacaatgatagcaattgcaagaataatgatcggtgcttttgacatcttctcttcttcttcgtcgtcgatatcatcataatattcatcctctaattcttctctgcgctgcggcttcggagctggtttctttttctttttcccatctcctactgcaaggagttcatcatacgcatcacgcatttcctgttcacgtttttcgcgtacttcttttggcggtatattcgaatacttctgttcttcaggttccggtttttccgctctcttctgtactttatgagcactctgtggaattttgaacttctttttgcaattatagcacaacagataattcggatctttttttcctggtcttaattcctgaccacatattggacacttcatatgaatctgtccctccccatagtgtattatttcaaactgtgctttgcgcctttcggccttgtatattccatatacattgacattatactacatcaatttacaaatatcaattttttatccaaattattccgattgttttcctaatgttacttcaacatcttttttctcgtattcaccattcttattctgtgtctgaatcgtaatttttactttttctcctgctttataatattgaagctgttcctgcaatgcatccattccatctacgcttgttccttcgattcctgtaataacggctccttttgtaatgcctgctttttctgcaccgccaccggagatcacttctgatacatatactcctgtcggcatattatacatctgtgcactgtctgctgttacatctacacctttgattccaatgtagcctctttcggattctgctaccttggtttttgtcttctgattcatcagatttgtgatcagatcacttacatcagataccggaatcgcatatcctattccctctactgtttccgttgcaatctttgcagaattgattccaatcacttctccatttgcattcagaagagcacctccgctgtttcccggattgatagccgcatctgtctgaagaagttttccatcgtaactatccattgtgcggtcttttgcagatacaatacctgtcgttactgactgtccgtatccgagagcatttccgatcgcaattacctgatctcctacctgtgtctgatctgaatttcccagtgttgccaccgcaattttatccatcgtagaatccttgatctcgcttaacggaactgccacaactgcaagatccttgtctgaatccgtacctttgatgtcagctttcacgcttttcccatctataaaggtaactgtcagtgtactgcttccttctactacatggttattggttgcaatcagaagttctgaatcgttctgtccaataataattccagaaccggcactttcactttcctgtttctgtgtaccaccgaagaaattctgcacttcctgtacactcatgtttgtaatggacacaattgacggcatcgcatttttagttacctctgttacatttgcggttcctattgagctgttggttgaagttgtcagttttgcattgctggtcgttgttgtcttagctgttttattcgttgtctgtgttgtaccaagaacttttcctgccacaatattactcgtctgaaatgcagcacttgcaaccactccaaataccagtcctgcacagaccacctttgcccatctcgctgcaccttttcctctttttttctgcggttcttttcccggttccccaccgccgccataatttcccgtattcatattctgatcggttgtataataattatattgattttccatatcttattgcccctttcatatcttatattggtagtgtacagcgtaattgtgtttaatctgtgataaaactaaggagatttattgatattcctttaatttttccagctttactcccacatcacccttgaactgtttccatgcatcttcatgttctacaaaatatttggggcaaatctttccagtcacatcataatgacgtataacatcattttcattcagatcgaacttcagacacagccacgcgcaaagatctaccatagactgatacgtcttttgattgaattttcccgtttcgtccggatgacagcattctatcgacactgtatcaatattcctgctgtttgaggcatacgccatctcccatgttggtacgcattgaacaatctcaccttccagacccacaacaaaattactgcttgctttcgtaatgtgactgtccttcaatccttcgaaataatcccggttattcatagccgaagcaccgggatttgctgtataatgaatcacaattcctgtaatcttatttgttgcgattcccgctctggaatactcattcggcgtcagcagttctacgtctatatccggtcttacagaatctatgtaatcacttttattttccgtatattcttccggctgctcctgcttttttaaaaccgtcaccgcacacagtacaactgttattataataagaatgatcagaccttttttagaatggcttctcgtttttttcatcttttctctcttttttatctatccttatatagtacacttttatctattttatcattcattttttaatgtacccgaaagagattcttatgtttttatgaaaattagcaaaacctatacgttgttgttgtatcatatacttctccggcttttgtaatcggagattcaaaattatctttatgaattgcatccgggaaatactgcgtttcaaagcatataccacaaccctttccatagacagctccttgctttcccttagctcctgccaggaaattgccggaatagaactgtatacccggaaggtctgtatatacttccatcttaatacctgtctcttccgattcggctgatgccacttttctgaatcccgacccgtttaatacccagttatgatcatagccgcctgccagtttcaatggtttataatctgctccgatctcttttgcaaccttttttccttcacggaaatccattggtgtgccctctacaggaattaccgttcctgttggaatcagttcagcatccgtctctgtaaatgcatctgcatccaaccacacttttgcattacatgcggttccggatgcatgtcctgccaggttgaaatagctgtgattcgtcatgttcaaaagggtatcctgatcaggaattgcataataatgaatctttaattcattttcttccgtaactgtataggatacttctatctttacttctcccgggaatccctgatccccgtccggactgacaagcataaatactacatgtgtatcatcctcctcttttacactccacattcttttattatagaaatctgttcctccatgaagtgtattttccccgttatcattcttcgtaagctcatatttcttgccgttcagttcgaatgcaccagttccaatacggtttgccacacgtccgacagtcgctcctacagaatctccaccattttcataatcctcaagtgtctcgtagcccaatacgacatcctgagactttccattcttatccggtacgtaaagcttcagtaaagcagctccaaaatcagatacaactgctttcattcctttgctgtttttcaatatataacagcttgctgtttccccgtttctcgttgttccaaattcttttttcatatccaggcatctcccttttactttattttttttaatattacttgtgtatttattatgtgcatttatataccaagcagactacctaaaccttattatactctatatattcatctctgaaaaccatgatatgaagaattttcaggatattttttctgatattattcatttaaactctctctttgccagacacatataatacaaaaaggcgccgttttcacgacgcccgaaccttttttattcgtctacactgtagtttggtgcttcttttgtaatatgaatatcatgaggatgactttcttttaatgaagccgaagaaatcttcacgaattttcctgtctgtttcaaatcctcaattgttggtgctccgcaatatcccatacctgaacgaagaccacccattaactggaatacagtatcttccacgcttcctttgtaagcaacacgtccttcgacaccttccggaaccagttttttcgcatctgtctggaagtaacgatctttacttccgttctccattgctgagatagatcccataccacggtatactttatattttctaccctggaataattcgaatgttccaggactctcatcacatcctgcaaagatacttcccatcatacatacattcgctccggctgcgattgcttttgtcatatctccggagtactttattcctccatccgcaatgatcggaattccatatttgtctgccgcttcatagcagtccataactgctgtgatctgaggaacaccaatacctgcaatgatacgtgttgtacagatcgatccaggtccgattccaacttttaccgcatcaacaccggctttgatcagatcttctgttgcaactccggtagcaacgttacctgcaattacctgcagatccgggaatttgctcttaatcatatcaactgtatgaataacgtttgctgaatgtccgtgtgctgaatccaaaacaaccacatcaacctttgcatctaccagagcctttgctctctcaagacagtttgctgtaattccgattgcagctccgcaaagcagacgtccctgtgcatcttttgcagataatggatatttaatctgtttttcaatatccttaattgtgatcaaacctttcaggttgaagtctttatctacgatcggaagtttttcctttctggcttttgcaagaatcttctttgcttcttccagagtaattccttccggtgctgtaatcaacccttccgaagtcattgactctctgattttctttgaaaagtcttcttcaaatttcaaatcacggtttgtgataataccaactaatttttttccctctgtgatcggcacacctgagattctgaactttgccatcagattgttggcatcttccagtgtattatccggtgataaataaaatggatctgtaataacaccgttttctgaacgttttaccttatccacttcctcagcctgctgttcaatagacatatttttatggataattccgattcccccctgtctggccattgcaattgccatacggtgctcggtaacagtatccattccggcactcatcatcggaatatttaacttaattttcttagtcaggtaagtagataaatccacctggttcggaattacttctgagtacgatggaactaaaagcacatcatcaaatgtaataccttctccaattatctttcccatgatttcttcctctctttcttttgcatattcatatttaacagctatcttagcgaatcatacccatatttgtcaacagcttttaacatgtttttattttaatacaatcttttttacattttacgtattattttctgattacttttcttggtgcttttacaaagaatccttctatgatcgtctcatttggctcaaacaaaactttacacagttctcctttgttcgaagcaatcaatgcatagatttctgcatgattttttcctgatgtataatcatatgtcctgaccttcttatactgcattaattctacagctcctaccggtgcaagaagttccatctgatctgcatctacagaaaacattctttttcttctggatttgttcatgatcttgtctatatcaagatctccattcacaaatacatactcatactccacattcatattgctgaataccagcacatcaaccacgatcattacaactggaaaaataatccccaccggtattgcaaaaaccaaaagcactgacaaaaccgtcaatacgatcagccccgctttcttaagcgtatcctttgagtccgcctgtttttttatcagctgctctgtgtaaaaatcatccattttttctttcctccaagtctgctttaagctatgtctattgtagcacacctgaagcaaaaaagaaaactcctctgacgaggagttctcaaaaatttaatattctgttacatcatacccatacccggatttcctgccggtacagccggtgcatcttctttgatatctgctaccacagattctgttgtgagaagtgtagaagcaacagatgttgcgttctgcagtgcacttcttgtaaccttagcaggatccagaattccgttttccaccatatctacgtactgttctgtcagagcatcaaatccggttcctacttctgattctcttaccttgttaataataacagcaccttccagtcctgcattggctgagatatggaacagtggtgcttccaaagctttcaggacaacctttgcacctgttttctcgtcaccttccagtccgtcaatcgcttcagcaactgctttggacgcatgaatgtatgcagatccaccaccggaaatgataccttcctctactgctgctcttgtggcgttcaaggcatcttccatacgaagttttgcttctttcatctctgtctccgttgctgctccgacacggataacagctacgccgcctgcaagttttgcaagtctttcctgaagtttttctctgtcaaagtcagatgttgtctcttcgatctgtgccttgatctgggcaacgcggtctgcgattgcattcttatctcccataccatcaacaattactgtattttctttctgtacctttacagattttgcacgtccaagctgatccatggttgtatctttcagttccataccgagttcctcagaaataacctgaccacctgtcagggtagcaatgtcttttaacatttcttttcttctgtcaccgtatccaggtgcttttacagctacaacattgaatgttccacgcagtttattaacgatcagagttgtaagtgcctctccctcaatatcttctgcgataataagaagtcttgctccagcctgaacaatctgctccagaagcggaaggatttcctgaatattagaaatcttcttatctgtgatcagaatatatggatcatccagatttgcttccatcttatccatatctgtagccatatatgcagatacatatccacggtcaaactgcataccttctacaagatccagctctgtcttcatagtcttagactcttcgatcgtaataactccgtcattagatactttctccatagcatctgccaccatctgtccgacttcagcatcacctgcagaaattgctgccacttttgcaatctgatctttgtcttttactttgcttgacatcttcgcaatggcttctactgccacatctgttgctttcttcattcctttacggagaatgatcggatttgctcctgcttccaggttcttcataccttcatgaaccattgcctgtgcaagtacagttgctgttgtagtaccgtctcctgctacatcatttgtcttagaagcaacttctttgatcagttgtgctcccatattttcaaatctgtcttccagttcaatctcttttgcgattgttacaccgtcatttgtgatcagtggtgctccaaaagatttatccagaacaacattgcgtccttttggtccgattgttactcttactgtatcagcgagctgattaacaccagcttccagcgctcttcttgcttctgcaccatatttaatttcttttgccattggtatctacctcctgaaatatatgaattaattgtacaattactcgcagatggccagaatatcatcctgttttacaatgatatattcctcgtcatcaatctcaacattcgttcctgcatatttggaataaattacctgctgtcctgttgtaacatgcatctcaacttctttaccattcaccattccacctggtcctacagcaataacctctgcctgctgcggtttttccttagactgtccaggaatcacgattcccgactttgtagtctcctctgccacacactgttttaatacaactctgtcacctaatggtactaacttcatatctattcctccttaattatttctgcattattagcactcaacaaaagagagtgctgaaagattctagatataaaatagcactctccttttggtttgtcaacacactttctatttagtttagaacttttttataaaatccattttgaattttaaatttcataaccctgcctgccttgttccagtaacgttcttttaatattcctttgcagaccacaggatctttcggatcctctatgctgcactcatagattccatccaaagaataaaaggtgagttccgcctcttccgataccagatacagcgtctcctcctcttcatcatatgctatgatcttgcataaatattccgtttcatcaaaaaaactgtcttccagaattacgcggtccattctgagttttgccgtacatcctccatatttcactatccgcatcctcctttatactgtgaaaagggtatcagttgcccgataccctttgtagttcttattattttgtacgttctgctttaatgcggtcaagttccgtaaatacataatcattgattactttaatatacgttcctttcatgccggaagaacgggattcgatcacacccgcactttcgaattttctcagagcattgacaattaccgatctggtaattccgacacggtctgcaatcttacttgcgaccagaattccttccgcaccatccaactcatcaaatatatgaatgattgcttccaattccgaatacgacaatgtactgattgccgattgtacaatatgctcttttctggtttcttctgcactttcttcattcacagatcttaacatctcaagaccaacaaccgttgttccgtattcactcaaaatgatgtcatcaatctcatacactttatcttttttatagataaacagtgtcccgagtctttcccctgcaatgtcaatcggcgtaataatcgcctgataacctttgacagcttcttcggaaaatcctaatgtctgaagatttacattttcttttgttgataagatactaagcagtcgctcattcagcatatcatctacatgttttccgatttctctctcgatcaattcggtaatgtaaggcacaccttcgcatttgcttccgccaagcacttttccttttttactgatcactaatacgttcgaatttaaaatttctgtaaggacttcgcagatatcattgaagacaactttactcgaactattgttatgcagtaatttgttgatttttctggttttatccaacaattgtacgcccatttacattcctccatccttatgaatgtatattatcatacaattctgaaatattcaacgaatatcattaattatccttattattttcaatattttctacatatccgcactgttcatcgctgcaaaccagtttatttcctttttccagcatgtatttaccacatctcggacatttttttgtcgatggcttctgccatgacataaattcacattccgggttatcctcgcagccgtaatatcgtcttccctttttcgtcttccggattaccacatctttaccacagacagggcatggtacacctatcttttccagatatggtttcgtgttacggcagtcagggaatcccgggcatgcaaggaattttccatgcgggccatatttgacaaccatattgcggccgcactcctcacagatcacatctgtcacttcatcttcaatcttcacctgttccagttctgtctcggctttttccactgctgcctccagatccggataaaaattctcgatgattgtcttccatctgacttttccttccgcaacgccatccagaaggctctccatatttgccgtaaagttcacatccacaatactcgggaaggactgtttcataatattattcactacttctccgatttccgtcagatacagattcttattctcttttgccacatagcgtcttgcaatgatcgtagaaattgtcggcgcatatgtacttggacgcccgattccaagttcttccagtgtcttaaccaatgttgcctctgtataatgtgccggtggttgtgtaaaatgctgcttactgttcagactttctttcgtaaggacagaatccatatccagtccttttaacagcacattgttctcttcttttgtctcgccggcttccgtatatacactgcggaacccttcaaaaacaatcttggatgcagcgactgtaaaacgatactgtcctgcggcaatctttacagaagtcgtctcgtatctggccggctgcattctgctggcaataaaacgtttccatacaagctggtacagacggaactggtcacggcttaagaattctttcactgctgccggtgttctggttacatctgtcggacggatcgcctcatgtgcatcctgaatgatcttcttgtctgaagatttcttaacgtctccatcggaaacatactcttcaccgaagccttccctgatatattctcttactgttgcatccgcttcctctgagatacgggtagaatccgtacgcaggtatgtgatcaatcccacagtaccactgcctttgatatccacaccctcatataactgctgggcaatacgcatggtcttggctgttgcaaaattcaatgccttggatgcttcctgctgcaacgtactggttgtaaacggtaccggtgccttcttggtacgttctcctttttttatatcggcaacagaatactccgcattttctacttctttcatgatctcgtccagttcttccctggatgagattgtcatcttactcttttctgtaccatagaacttagcagtcagaagttttctttctcctttgaccttcagatccgcatccagtgtccagtattcttccggaataaaagcattgatctcttcttctctgtctgcgataatacgcaatgcaaccgactgtacacgtccggcacttaatcctctcttaacctttgcccacaggagcggactgatcttgtaacctacaattctgtccagtacacggcgtgcctgctgcgcatccaccaaatccatatcgatttctcttggattcttaagcgacgcttttactgcattcttagtaatctcattaaaactgattcgataaaccttcttatcttctaatttcaaagctttactcagatgccaggatattgcttctccctcccggtccgggtcagttgcaagatatatcttgtccgcctttttgacttccttacgaagcttcgcaagaatctctccctttcctctgatcgttatatactttggttcgtaatcattttcaatgtcgatacccatctggcttttgggcatatctctcacatgaccgttcgatgcggtcactacataattacttcctaagaacttcttaatggtcttcacctttgcaggtgactccacgattaccagatagcgtgccataatttcctccataataccgaccgttcttacaacagccttatataataatttctggatacttcttctgcgtatcctttcaattccaaagtaatcagtctttccatcaattctgaaatagaaagttctgtttctttcatcagttcatcgattcctttcgggaacaaatcgagacaactatacaccatacgctcaggactttcaagcattttttcatttttgttatttttttgtccaatttgcatccgattcagattccattcatccatcagttcttccggtgtgatcagtattcccgctccctgccggatcagtctgtgacatccctgactcaacgcacttgtcaccggtcccggaagtgcatagacatccttcccctgatccagtgcaaaatctgcagtgatcaaagatccgctcttttcttttgcctctatcaccagtatccattccgccagtccactgataatccggttccgcatcggaaaatttcttgcaagtggttcggttccgggtggaaattccgatatgattccgccttttttttgaatgtccatgtataatccgatattttctcttggataacacacatccactccacatcccagaacagcaaacgttattccgtctccgttcaaagcacctctctgccctgctccgtcgattcctctcgccataccgcttatcacctgtactcccgcatgcccaagacatttcccatactgcaatgccatttgttctccatatgaagtacaattcctggcccctacgattgctgcgcttttcacattttcatccggcagcgatccaagtacgtacaaggcgtacgggggatctgtgatcactttcatttttttcggataatcatccgaaaaatacggcacaaattttatcttctttttcacggatttttcccattgcatttcgagattaactgttttctttgcttttttcagtctctctatatccttctcattcagaaatgtatgtttcttcaaattagtttcttctatataatatattgcttttccatttccatatacctctcttaattttctttttttcagattcgaaataccttctatccctgccagccagtattcatatatcattcacatcctcctaacgtccccagtacttcttatccagtgaccggtaagcaatagcttcttttaaatgtttctcctttaccttctcactgtaatccagatctgcaattgtccttgccacacgcaggatcttatgataggtccttgctgtaagcccgattctttcaaatgcaagctccatcatctttctttcacgctctcccagttctacgtaatgtccgatctcctgcggtcctaatactgcatttgtcctgatatctgttcctttatatctttccctctgtatattccttgcatccgtcactctgcggcgtatcgtctcagatgtctcttccccttccagatctttccgttctccgtccagatcccggtatacaactttcggagtctctatgcagatatccatacgatccaggaacggctggctgatcttgccaaggtatttctgaatctgcccgggtgtgcaggaacatttctgcacatccggataatttccgcatggacacgggttcattgctgctaccagcataaattccgccggaaatgtaaaatttccataatttctcgcaatatgaatctgatgttcttccaatggctgtcttagtacttccagaacatttcttggaaattccgcaagttcatcaagaaacagcacacctccgtgtgccatactgatctccccgggcatcggtattctgccgccccctgtcagcgctgttctggtgattgtatgatgaacattacgaaacgggcgctgtgtgatcagcgggtattcctgatccaccagccccaatacactgtagatcttcgtaatttccaaactttcctcccatgacagttccggtaaaatggttgcgatccgctttgcgatcatcgtttttccggatcccggtgatccagccattaacagattgtgccctcctgccactgcaatttctgctgcacgtttcaccgctttctgtccgcagatatccgcaaaatcttctctagctctatgttgtctgtttttttcattttcttttttctcccttttagacttttccgaacgcgcagctccgttcagatacgcacagagttcctccagattatctgccggtagaatctcgattccttttacgagtcttccttctgtctcattctctccgggcaggataaagcttttacatccttgttctttcgcctctatcaccatcggcagaactcccggtacacctcttattttcccctccagacttaattcccctgttacgatcacccgttccattgcttcttccggtatataccccatagctgccagcaccgccagagcaatcggcagatcaaacgatgccccttttttccggacagttgccggcgcaagattgacaatgatcttctttgccggaagtttcatccctgaattgcggattgctgttctcacccgttctgatgcctctttcacttccgaagacagatatcccaccatatggaacatcggaagtccgttacttacatccgcttccacacggatcatctctacccccagtccctgaactgaagcagataaaactgtacaaaatgccatctgcacactcctttccataccagaccatgcagaacctgtccttatataagcatcttttctgccttatttgtccggcactcatataaaattgttttgatatagttgataacttgaccgatccggtcatctacagaatccgccactggcggtccagatttagaaaacgaaaaagaatagtctgtacttgatcactcatcttcgttaaatgtgcaatcatcatagcctattctttccgccgtgtcaatatttttctaatttcactttcattttactttttgattttctatccatgcgtccaagcacgatgctaaagattccacttaatatcagcaaaaaataaaagctgattccccgattcaccagtactgccgctgccaccggaacagaagtaaagatacctgcaaacaactttacaaatgagaattcactaattccctcagctcccgggaacggaagaagtgctgtagtcatatacaaaatgatctgatgcagaaacatacttccataagaactgccggactctcccattgcatgatacactgcccatggaacactgaaccagcagatgatctggatcagactgactgttgtcatttttaacgcaagtaccggatcccttttaaaaaacaatttacaatcttcaaaatcacgaacaatctcgtccatcttagcgcccaatctcttcttattcccaaacgggagtttcatgatcaggaaacgtattccatttacaatcttctttttcagaccttcggataacattatgaccaccagtgctgctataaaaatcagattcatcagatacccgagagccgccaatgccagcatcatcttattcagacgtatccttcccgtcagtatccagaacgttgctacattttccatcagaaatgctgcaatctgaaaactggtgagttctgtcagaagagccatcgttccatgtgccacatggatattatccttattcatcacatataactgtaccggctgtccgcctgttgcagatggggtgatcgaactgaaaaaatagccggtataagcatatttcataccctgtctgaaacttacctgatatccaaatgaattcaatacgctcctcagattgatcgcttccgcgatattgaataccgccgcaagtataagccctgctgccatccattgcggcttcgcacttttcatggcattccacacagattccatatctgcacccttcaaaataacgaaacataccaacagtactaaaaccggaaataaaaccatatactttttaatcgatctctgactcacctgctgttccatatttttcttctatccttctgaattcatacccctgcgctttcaacaatgggattgcttttttcaatgcttctatcgttcttcccggtgctccgttctcccctctgccgtcatgcagacagataaccgcacccggaaagactcttcttaatatcttattgcagatactgtccggggtctctttcgctgaccagtcctgtgccatcacatcccagaataccagattcagatgcagcttccgtatccagaacagacttgccaggttcagatgtccccacggtggtctgtaccatttcactgcaatatccatcttctccataatctttttcgattctttcacatcccggccagttcttcccggtccggaaagcatcgcactttcgtggctcaacgaatgtattccgacctggtatccgctctttctcatccgttccacgatcccgggatgcttccgagcagatcctgcgaccatgaaaaatgctgccggaatctgttccttctccagaaaatcgagtaatatattcgtatatactgtatccggaccatcatcaaatgtcaggtacaaaaccttctcttcccgggatgtcctctgtctgcttctgaaaatccaacggtatttcagcaaatacgtcggaatcacactataactcagtgctgcggcacaggccagtcccagctttgcagtctttggtatattcattatgccgtcatcctttcttccatgatccctactgcctcatccaatgatacttctatcatctctttacaggcacaccttacatttccggtcatttcttccatcattttttcatcacttaacagcttttccagttccggaatatagtcttcacgtctgccccatatgactttggcaaatcctttttctgccgcataccttgcattattcatctcctgctccagaaacgggtggatgacaaatagcggaacctgactgtgcagaatttcaaacaacgtaattccacctgcttttgtaatcacaaggtctgccccacgcatatatctgctgatattttccgtgtatccaagtacttccacatcctcatagcggttcacccattcctcatacatcttatgattttttccggtaatgactacgctctcaacgccttgcatgctatgtaatttttcaagcaattctttcagatccggcatcagcccaagtccgcctcccataatgagcaccctgcgtgttctgtttctttcccgtttctgacggtaatctgcatccaggaactgctggcgaaccggaattcctgtcacaagaatatcttccgccctggtcccctccttcatcagatgccttttgatctcctgtgtcggaacaagatagatgtctgtctgtggtgctgtccactccggatgcatactgatatctgtgatgcaggtcacaagtggtgttttaagccctgtcttttctttataggatgcaattgcttttacacacatcggatgtgtacagacgatcacatctggttgttctccatccatgatcttctttaaccttttatagagtgcctttccccttggctgtatttctaccttcatccttccggacattttgtagataaaattataaatcccgtaacagtgctctaccatcatgcggaatccaccgaaaatgaatttactgatatgtggatataactcttccagaagatcttttttttcaatttctgcctgttcatctattttccggaactgttcgcagatcgcattggctgccatctcatgtcccattccaaatctaccacttaacaccagtactttcataactgccaccctttctcacataccattttgcatgcctctttcttatggtgttaagtatagactttgattcttaaaataacggatatagaattctaaagattttttaaagacttttctaagaagtgaaaaagtttcttaatttttcaatcgcactcttctcaattcttgatacatacgatctggaaatgccgagcattgctgcaatttcccgctgtgtatattcctcttcattatacaggccgtaccgcagcttcagtaccattcgttctctctgagacaataccgattccacctgctgatacagacggatcacatcttccttacgttccagtcttcggtagacatcttcttcattcatctcaatcacatcaaataattgtatctcattgccttcccggtccgttccaatcggttcatacaaagatacttcttttgaactttttttcttacctctcaagtacatcaatacttcattttcgatgcaccttgctgcatacgatgcaagccttgcgctcttatccggatcaaacgttacaacagccttcataagcccgatggttccgatcgacagaaggtcttccatctcttccggaggcggctggtactttttcacgatatgtgcaaccagacgcagattccgttctattagaatgtgctttgcttccagatcaccctctgtatatttctgcatatagtacttttcttccgctgccgtcaatggttggggaaatgacttcaagacaaagcacctcttaggcagatttattatattctatgcaaaaagcagtgattctgtgcttttccatttttgcactaaatcactgctttctctgttacttgtctgtcctattccgttacatcttcctggcgtcttaaaatatcatatacggaagcttctccgcttaatgccacatacagcacctgctttggatgcggcgcactctcctgctcctgcccatcctcatctatgatcttttccaccgttacttctacgttctgtccgtccggtttcataatctcgacagtctcacctacagagaacttatttctctgttcgatgcggtacatgccctctttaatcccgccgataatcccaagataagtgtactctttgatatacgtgttactatcgtagatctggctctcgtcacccggttttccaaaataaaatcctgtcgtaaactgacggtatgtacaattcgaaatctgatccctgtaccaaggcatattcgcctcatatttcttcggatcctccagataatcatcgatcgccttgcggtaagttcttgcaaccgttgccacatacagagccgtcttcatacgtccctcgatcttaaaactatcaattcccgcatcgatcatttccggaatgtgttcaatcatacacagatccttggagttgaaaatgtatgttcctctttcattctcatacaccggcatatattcgcccggtcttgtctcttctaccacggaatatttccaacggcacggatgtgtacaggcaccctgattggcatctcttcccgtaaagaaattgctcagcaagcatcttccggaataagaaatacacattgccccatggataaaactttcaatctccatctctgccgggatatgcgcacggatctccctaatttcttttaatgaaagttctctagctgttaccacacgctttgcccccaggttccaccagaagttgaatgttccatagttcgtgttatttgcctgtgtgctgacatgtctttctatctccggacaaatctcttttgcaagcataaaaattgccggatctgcaatgatcagcgcatccggtccgatctcttttagttcttttaaatactctgccgcaccttccaggtcatcattatgtgcaagaatatttacagtgacatgaactcttgctccatgctcatgcgcaaactgcacgccttctttcatgtcttccatagagaagttctttgcctttgcacgaagtccaaatgcctctcctccgatatatactgcatctgcaccaaacataaccgcagtcttcaacacttccagactgcttgcaggaatcagtaattctggatgtctgtttctcatcttattgattctccttctcctcttttttcttcttgatactgagtgccacaccatcacccaacgggatgatcgatgtctccagcacattgctgtgctttaattcatagaggtaatcccgcatacggctgtggatggtacggttccgcctctctaccgcaaatctggattctatgatatccccatcctgtaatacgttgtctgacatcaggatacctccatccgcaagcagtcttactgcctccggcatataatggatatactgtcccttggccgcatccataaagataaaatcatatggaccttccagggtcttcatcacttccagggcatccccttcgatcagcgtgatctgttcttctttccccgcacgcttaaagttgtttcgcgcaatcgggattcttttttcatagttttctattgttgtgatacggcttccttccggaagatattcactcattaagattgccgaaaatccgactgctgtgcccacctccagcactctggccggacggttcattaacatcattacctttaagaagctctgggtttctttgcggatgatcggtacgaagttttccaatgcttcctgttcgattgcctctatcacaggattctccggacgttccaacgaccggatgtatgtaaccatacgttcatctacgatcatagtatctctacctctgttctaactgtttgtacctgttctttcctgcagtttctcttaggattctacaaggaaacgagccgtacattgtacaaaaccagcctcacacactgtgtcggaaggcgccggtttcgtactatgtggcggctcatttttttctttttttatacgtccataatgattgggaggatcattggtcttctcttggtacgtttccaaatgaaatcgttcatcgtatcacggatcacaagcttgatcttactccagtctgcgttgcgctgatgtgtcagacaatcctccactgcatctgtaaggacttttcttgcctcttccatcaggctttcggactctcttacatagacgaatccacgcgatacaatatccggacctgcaagaagctgattgcttcctttttccagtgtcagtacaacgatcataataccgtcttccgccagatgctgtctgtcacgaagaacaatatttcctacatctcctacaccaagtccgtctaccagaatctctcctgtgtgtacattgtctactacttttgcttccttctcactgacttccagaacattaccggatttcaggatgaaaatattatctttcggaatgccaagcattctggcaattcccgcatttgctttgaggtgacggtattctccgtgaaccgggatcgcatatttcggttttaccagagaatagatcagtttcagttcttcctgacatgcatgaccggatacatgtgcatcctggaagatgacattcgctcccttagctgtcagttcattgattaccttggatacagacttttcatttccagggatcggattcgaactgaagatgatcgtatcaccaggcatgatcgttactttcttatgcacatctgctgccatacgcgacagagctgccatagattctccctggcttccggttgtgatcagaacggtcttctccggcggataattcttaagctggtcgatctcgatcaatgtcttatccggaacatttaagtatcccagttcctgtgcaacctggatgatgttcaccatgcttcgtccctctacgaccaccttacggtcatatttacatgccgtattgatgatctgctgtacacgatctacatttgacgcaaatgttgcaatgataattctggtatctttatgctctgcaaaaacatgatcaaatgtgatacctaccgtacgctctgactgtgtaaatcctggtctctcggcattggtactgtctgacatcagtgccagtacgcctttcttaccgatctctgcaaatctctgcagatcgatcgcatcgccatataccggtgtataatctactttaaagtctcctgtatgcacaacaataccggccggtgaatagattgccagtgctgccgcatcctgaatactgtggtttgtcttaataaattcgatacggaactgtcccagattgatcgactgtccgtgtctgacaacttttcttcttgtactgcggagcagattgtgttccgtcagctttttctcaatgattcccatcgtaagctttgtcgcatagataggaagattcagttctcttaatacataaggaagtgcaccgatatggtcctcatgtccatgggtgattacaaatccttttactttctgaatgttatctttcaggtaggtgacatccggaatgaccaggtcgattccgagcatatcctcctccgggaaagataatccgcagtctacaacaataatactgtcttcatactcaaaagctgtgatgttcattccgatcttttccagacctccgagtggaatgatacgcatttttccattgttttctcttttcaaaattacacctccacgtgtttaccgcactacttttttctgcctcttttttggcactccctgcactgtccatagaactttaattcgtggtctaacacatgaaatcccgtggtatcttcgatcttatcttccagatcttccaacagatcatccttaaacggaagaatcttaccacatgttctgcatatcagatggtgatgatgatgtctttcttctccatcaaagaattctccgatttcataacgtgcacatccatcgtcaagactgatacgatccaccaattgcatttccagtaacaactgcactgtccggtatatagttgccagcccaatctccggataatcttctcttactaattcataaatatcttctgcagtcagatgcttatcgcggtgatctgcaaggacctccagtaccagtatacgctggttggtaactttcaaccccttctctctcagcatttctttaaacttctctttactgatagacattccaaactacctttcaatctctacatcttcaagtagttcttcaaatactttcagaacagcagaaagctctacatcatcctctacgatctcgtatacgctctctgactggctctctcctgatgtgtctttcagaatcagacattctgcatcatcttcttccgaatccgtcaccagaatatatgacacaccaccaactttcgtctgttcaagtacataaaaatctacttcttcattcatctcttcggacatgaatttaatcttttccatctgcaatctacctcttaatccagtggcgtgtgtgcaagtgaatccagatatccctgcaatataaaaacagccgcaatcttatcaatatatttcttacggtcttcacgccttaccttattctctattaaagtccgttcagcttctaccgtggtcagacgctcgtcccacatcacgacctccaggccggtccgtctttttaacatctcaccaaatgccattgatttttccgcacgatctccaatatcattattcatatgcttcggaagtccgagaacaatcttcgtaacctgatactcttcaatcagtgcttcgatacgcgcacaggtctttctgagcttgttctcgtcctttctgcatattgtctctactccctgagcagtaattcccaacggatcactgaccgcaacgcctaccgtcttggatccatagtccagtcccatgattctcatagtcattattcccactcattatgctcgatatacgtcttgagcatctcttctaccagttcatctctttccatcttcatgatcagacttctggctccgttatggcttgtgatataagtcggatcgccggacataatgtatcctacgatctgatttaccggattatatcccttttcactcaatgccttgtatacaatttccagaatatcttttgcactgatctgcggtccactttccacctggaaaaactgggtatttgtcatatttttcatgtaatcacgtcctccaaaaatatttcaattttattctacatgattaaatcttaaatttcaatgcaatatttgtaattggttttcaatttctacatttacaagctgattaataagattattcggattttttacaccaattttcacatattcctttgtgtggccaatctgtaattcttctccgttgcgtataattttctcttcgatcagaacttcctgcgtggttccgatcagtctttcttcgtatgcggcctgttttctatggctcagttctataagttccgcacttcttacagccttgatctgatccgggacctggtctttcattgctgcggccttcgttccttctcttctggaatatttgaaaatgtgtgtctcgtagaaatccactttatctacaaatgcttttgactcggcaaattcttcttccgtttctcccggaaatccaacgatcacatctgttgtaagtgccgggttacggaaatacttacggagcagccggcatttttcgtaatactcttctgcagtgtatctgcggttcatacgcttcagtgttgcattgcatccactctgcagtgacagatggaaatgcggacacatcttcggaagttgtgcgatcgtctgtacaaattcctccgtgatgattcttggttccagtgatccgaggcggattctttcaattccatctacttcgtggatcgcaagtatcagggataacagattgtcatcgcagtcgattccataggaactcaggtggattcccgtcagcaccacttctttgtatccgttggccgccaatgtctttacttcttcaagtacgctgtcacggcttctgcttcttactcttcctcttgcaaatggaataatacagtaagaacagaactgattacatccatcctgtaccttgatatacgctctcgtatgttctgctgccgtgcttaaatgcagatcttcatacgctttttcgtgattgatatccagaatctcctgataagtctctgccgccttttcctgttttgccggtgttccggcctgggcatccggatttttctctttctcataattttccaggatctcgacaatattctgcttcttgttatttccgatgacaatatcgatcccatccgggatgtcatcttttctggcctgcacgtaacagccacaggcaacgacaatcgaatccggattcatctttcttgccctgtgcagcatctgtctggatttccggtctgccatatttgtcaccgtacaggtattgatgatatacacatctgcaccttcctgaaacggcacaatctcatatccgtgcttttccagcagttcctgcatggcttccgtctcatacgcattcactttgcacccgagattatgcaatgctactttcttcatgtatctgttcctttcttttttacacattgttgtaacttctaacgaaaatcttctgaattctttggcaatttgtttcttgacttttcttcgtctgactcttaatatatctatagaacaagaaatgaatcaaggagggtattccaatgaaaacagtaaaaatttctttaaattcaattgacaaagtaaaatcatttgtaaatgacatcacaaaatttgattatgattttgatcttgtatccggaagatatgtcatcgatgcaaaatcaatcatgggaatcttcagcttagatctttctaaaccgatcgatctgaacatccacgctgatgataatgtagatgagatcatggctatgttaaaaccatatctttgtgactaattcgtcattaaagtaaatgatctacttagaaaaagggctgacctgtttaagggttcagccctctttttttattttacttcaatgacctcaacagtctcgatcgcctgcttcatcagctcatcaatcttttcattcaggttctcttccgaacgtcggatcacatcaatattcggctttgttaccggatgttttgccacgaagatcgtacagcagtcttcgaatggctggatggatgtctcgtaagtatcgattttctctgatacatccacgatctcctgcttgtcaaatcctatcagcggacgataaaccggcatcgtacatacatcgttggttgccgcaaggctctgcatggtctgacttgccacctgcccgatactctcgcctgtgatcatacctaagcatccatcttcttttgcaaaatgctctgcaatacgcatcatatatcttctcataatgatcgtcagttcatcgtgcgggcactggtcatagatataaagctggatgtcagtaaagttaactacatgaagcttaatcggtccggaatattttgctaccttcttcgcaagatccacaactttctgttttgcacgctcacttgtatacggcggtgcgtggaaataggttgcttcaagactcacaccacgttttgataccatatatcccgcaaccgggctgtcaataccaccggataacagcagcatcgccgaaccattcgttccaaccggcattccgcctgctcccgggatgatctgtgaatatacgtaaatctcatttcttacttctacattgaccataacatccggatgatgcacatcaaccttgattccgctctccggaaatgcatacaaaatagcctctccaaggtcacggctgatctccatagaattcaatgggtacgacttctttgcacgtctggattctactttgaatgtgaagttcttatccggatacatctcatccatatatgccacaacgtctttcttcagttcctcaaatcctttatcctccatacggacaaccggacagattccgaccagaccaaatacctttttcagatgttctaccgtctcatcataatcgtaatctccttcacagtccacatagattctcgcctgtgacttatgcacatcaaactgtccgtccacatcctttaatgcatagcgcacctggcgtaccagtgcatcctcgaacagatgacggttctttcccttaattccaatctctccatattttaataaaaatgtatgaaatctcatcttctgattcctttcctgatttctttctcttttatcgtgatctacttaatgtctggtatatcttctaagcatcggtactatattatatagtgcatcgagcgtatagtcaatctcttccatcgtagtaaattctgacatactgaacctgagggtcgcatccagaaactcctgccttgcgccgattccctttaacacaccgctgatctgtggatgattggatgcacatgccgaaccggatgatacatagattcccttatcttccagcgcatgcagcaatacttcactccggatacctgcgattcctacactgataatatgtggtgccgatgtctcatcatataatccgtggatcgtcgtattctcaatcttttccacgccttcgatgaaatgctgctttagcatcctcatcttctctaccttcttatccaggttgtcgtaaaccgtctttgctgccagggaaagtcctgcgattcccggtacattttctgttccggaacgcatatcatgctgctggccgcctccataaacgatcggacggatctttacattttcaccgatgtataaagcacccacacccttcggtccgtggatcttatgaccactgacggaacacatatctaccttaagtttcttcgggtaaatcttatattttccaaatccctgtaccgcatcgacatggaataaaatatctttattatatgcctttacgatacttgccgcttcctggatcggctggacagaacctacctcgttattcacatacatgatcgataccagaatcgtatcttcacacagtgcttcctgcagtgcatccagacggatccttccatactgatctaccggaagataggttacacggaatccttcttcctcttccagaaaacgcatggtattaatgatcgccggatgttcaatagatgacgtgatcaggtggttgcctgcacgcttgttcgcccttgctgcaccgatcaatgccatattgtcactctcggtaccgccggaagtaaaatacacttccttttcctgtactttccatagtcttgcaaatgtctcttttgcttcttttatatatttttctgcttccacacccttgttatgcatggaagacggattgccatagtcttcacacataaccttctgcaccagttccccgacgcttcgatatgccatggtggtcgccgaattatccagatatacttccttcatttcttcacttcctgtactcttcattcttagtattagattatgtctctacccttccagatggaacatcagaaccgaaagcattgtaagtccggccgtctctgtccgtaagattctcttcccaagtgtcagcggctctgccccggctttcacagcctgttctacttcttctttctcaaagccgccttccggtccgataaagatgccgaccgactgccccggccggatctctgcaatgatctgcttcgtcttttccatgccttctgccagttcatacgggatcaggacaacatccagttcctctgcatacttcagggcctgtgcataggtacacacttctcccactgctgggataatgcctcttcctgcctgctttgccgcactgactgcgatctgctgccagcgttcgaccttcttttttgctttctttgcatccagctttaccactgcacgcttcgttgccaccggaatcacctggtatacacccagttccaccgctttctgcacgatcagttccatcttgtcctgttttgggagtccctggaacagatagatttttgacggaagttcgctctcatccttctttttctccagaatcttaagtaccgccatgtcttcttcgtaagattccaccacacacaaatagagccacccgtcaccgtccccaatggtcagttcctcgccggtcttcatacggagcacattcttcatatgattgacgtcactgccttctacatagattttttcttccctcacctgttccggtgatacaaaaaaatgctgcatatcagatcctctaattctttcttgctgttacagatacccactcaccctggtgattgacttccaggacttccaggcctgcctccttcacagcttctactaccacgtcttctttatcttcgatgatgccactcgtaatatagataccgccttttttcatctgatgaatgatcacaggtgtcagcggcaccagtacatctgccagaatatttgctgctacaatatcatatttttcatatcccaccttgtcctgtaccgctttatcatcaatgatgttaccgatcatgacttcatactgatctctgctgattccgttattgtccatattctcatatgttgcatcgatcgcacacggatccagatccgttcctacggaatgctttgcgccgaactttaatgccagcattccgaggattccgcttccacatcctacatctaagatttctgtatcctctgtcacatatttcttaagctgacggatgcagagctgtgttgtctcatgcataccggttccgaatgctgtacccggatcgatatggatcaccatcttgtcactgtccttcgcctcgacattttcccatgaaggaatgacaagaatgtcatcaatatagaactgatggaaatactgtttccagttattcacccagtctacatcttctgtctgtgattcttcaatcgtacactcccctacattcaggtaacttctcatctcttccaattcctgtctgactttcagtaacagttcctgtttgtctacatcttcgtccagatagaatgtcagatatgcacatccatcatcttccggtatatccggcaggatgtctacgaacatctgctctttgtcagactgggtgagcggtatcttgtcctcgatctgcactccctcgattccaagatcagcaagcatgctgctgacgatatcttctgcctctgtcgtcgtcttcaggcgaaactgattccatttcatatatattctcctttatgtcatcttatattttttacgttcattcatcgtatatgctgctcttatatgcgttatatccgcaatcctcccagtatccatatacattgtttattctaacacctgtgccgtttaaagtaaatgtacttcttttgttaaaactccgttaagaaattaacgtattctgttcagaccgtgttaagaagccctttcttctctttcactgccttgccaaaatgcatataatgtatccggaagcaaaattccatatcatatttacacaaaagctgccacattgggttctttgaaatctcccggcggcgaacatcagcaaggaggacttttttatgaatattggtattttaattcttatgatcatcggcggaggtgtcggcgtactgtcgtctctttatattgcactcagttttccggcagtcattatctggaaaattttccgtaagatccgccacggatataaacttacatattaaattttaaccattattttacggcagtgttcagatcctgttcgatctcatccatttcggacaggatctcttcctgttgtttgtcaaataacaatttcttattgtactgataatacttgtcgcagtcattttccttcaggaactgaatactgtaataattcgtgttaagctctgtcacgaaagagaccatctcctgactgtctccgaatgcatcttccatgaactcaaatgcgtgttccagcgcagcaagtgtatgctctgtcagttcttcccgccctgccacttcattgccaaacaattcctttacacgttcaaatgctgcttctccatccagatgttcctctttcgtaagctgttcataggactccagcgtatccagtacctgtttgcgtacatgatcttcctgctttgtcatctgctcttctttccggagtttttcgtacttctccctcgcttcacagactacaagatcgatctgcagattggatcttaataacttcagatattcatataagatcgtcacaaaccggtctttcaggaaataatctttaaagcaagttcccagtcttccgatcagcatgttaactacactgagacgctcatcaaatgctgcatactgcagtctttccaaggtgtcctttgtgtagacaccttcaatgatcttctcaagtccgtaatctttcttgtattttctgtacagttccagataatttgcaaaatcctttgcaatcttccagtgctggatatactgatgaacgacctctctgtccgctttctttcccagcttctcatatgtcttcagaagctgtgacagatcttcccatcctctggccgttgcaaagactcttccgtctactgtcgtctccatgcgatagaaataatctctgcggatctccagatatgcaaggattgccggatggatatctgcctgatatgcgtattctttccagacatcatagttcacatccacatcgatcttcttgatacgatcgagcgtcaccacatcaaaatcgcgaaccgacttattatattccggcggattgcctgccgccacgatgatccagccttccgggatcttctgattgccgaacatcttacactgcaggaactgcagcatcgtcggtgccagcgtctctgacacacagttgatctcatcgatgaagagaattccttcttttaatccggtctcttccatcttatcgtatattgaggcaataatctcactcatcgtatattcggtaacggaatattcttttccgctatatacttttttttcaataaatggcagtcccaccgcactctgtctggtgtggtgcgtaatcgtatatgccacaagcgccactttacactctttcgccacctgctccatcacctgggtctttccgattcccggaggccccatcaaaagaatcggtctctgtctgatctgtggaatcatataatccccaaactcatctttggcaagatatgcctcgatagaatctttgatttctttctttgctcgctttatatccatttattttctttcctccatgtatttcaacatttccttaaaagtcctgcccttcttccagaatgatcttgatcgcccatggcgggacatccacgtcctcatattcttcctccatgaacacaaatgctgtctcgtagactgggcgcttcgccggatagattccacgtccgtccgtaaaatagatcatcccccgcagatgttcaaatgcatgctgccggatcatttcgtccacataggcaaatgccgggcggaaatccgttccgccttcgccttttaattctaacttctccatataagatttcaattcttcctcacaggtgatcttctgatccgtctggatctggtcatcacactgtatgatatgaatgttcaccttccgaaaaaaactgtcgttctcactcaacacaccgtatgtctcttccagaaacttcttcaccagttctccggagcacgacattgatgtatcgatcacaatcacaaattcttcgaccttctggacttccttccactcctgcggctcgatcaatggcatattcccatacaacgacaaaccatagctgtagaaattataatcaaacgaatccgggtctaccgtcatctcttcttttaaaaccgaaaacttccgtaagaattcccggtaatccatccgttcccggttctcgaccttcacctgatcgatcagaccgcccgaactttccgatgcttctttggaaaatgtctccatctccgtctccatacgttcgctgatgtcctgccactgattctcgatctggctctgcttcttcttatcctcatctttcggccagtagctgtgatcgtccacacggaagtctgactctaactgtccaagcttcgtttccggaaattcttctttcttcagcacttcatatacccgttctgccgtcagtgtcttcatttccttcttcagcatccggtacatctctcttctcggaagagacctggccttcatcacacagcggtactgaagcccgtcgatgatggattctgccacaatgtcgcaggccagatgataaatccgctcttctcttccctttctccggagcatatgccggaagataccatgcagtaccagatgcagatagatccgattcaccataacgcgatcttcccggaacaatccccccagatactgcggatcataataaaggtacagtccatccgttcccatgccgtccgcaccagtatccggtataaatggcatgcacgacaatgcaacgtccaggaaacgcatcttcatataaagctcatttcttgctgtgatcaggatctttcggctgacagactccatacgttcctgcatggcagttgactgtgacacagcctctggttctgttgtttctttctttatttcttcattttttatacgtctcttcgtatctgccatatgattttccgctttttctccttacaattcaaacgtctttttcttcttcgggaacaactcttttctgacatccataagcacactcagactttccgtcctgttcccctctgccgctacatccatacctttctgtaaagacggttcactccacagcttcttctgctccaggaaccggattccttctatatcttctctctttaccagatacgctgccaccgtttccatatgctcccgtatgtatgttttgtagacatttttgttcttctccgacaattcctccgggaaacgcagacggtccagtgcaagctccaccgccgtctcttctgtatcctccgcaaccgtatgatagaacatctcatcatatttcttataatctaattcccggttataaaaacactggcggtagtatcctcccgcaccatgatggtgtgtctcaagaatccttgccggggtgttctcaaccgcctcttcatagtgttccggaaatagaatccgaacttcccgcaaccattcatctgtactgtttttttctgcgcaacatctccaactgtatccgtataagcttacacggatctgataacgcatctcttctacaatggatttcagacagctcttcttgccctcacggaaatatatctccacttcttccagacgacaccccgtcaatgcaccgccacccatatcgagcagttgatttcccagaatcagttttttcaggttcctgcaccggtagaatgcgtaacgaccgacttcttttaacgcttccggcagccagatctcttccacttccagattcctggcaaatgcataatcatccagtgcggtcacagtttctccttctatctcatccggcaggaccacacaactgtccgctccataatattcggtgatcatcatacccttcgctgtcattttatatctgatctccgcagtgatcagattatcctgttttttattctttatctgttcatttatttttgcatccatattccattcatttccgtccctttttctttcttccctatactactatgattccctgctatttgcaaggcagggcataactttgtatccgctgcatatatatgaataaatgattcttgcggagttcttatgtcccggttacataattacaaaccattgatcctcttactcttcttttcattctgtttctttgcaggcggacagattgcccggatctttccgcctgcgtctgtcagaacagatgatagaagtccatccggaaatgcagcttcctccggcacagttccggcagcctcgacttccggcaatcccctctccacgattctgccggctgccgaaaactggggtctcagctttcaggaggaaggcaaagttcctgccggtaatgcatctttcgatgaacttcagcaatatcacgcctactatgcacaaaaaacggataaaaaagtcatctatctcacttttgactgcggctatgaaaacgggaacacaccggctatcttgaatgctttaaaacgtcacaacgttcaagccacattttttgttgtcggaaactttctgcgtgataatccggagctggtaaagcagatgttaaaagaaggtcataccatcggcaaccatactttccatcaccccgacatgtcccagattgcaacaaaggagacattttccagagaacttaagagtgtagaagctctgtataaagatatcacagacaaatccatgacccgcttctaccggccgccacagggaaaatacagtactgaaaatctgcagatggcaaaagacatgggatatcataccttcttctggagtcttgcctacgttgactggctggccgacgcgcagccatccaaagaagaagcctttgacaagcttctcggacggatccatccgggtgccatcgtgctgctgcataacacctccagaaccaatggtgagattctggatgagctgcttgcaaaatgggaggagatggggtatacattttctacactcaaaaagcttgtcaggaacacttgaaaataaaaaacgaaccggtttgcttccatcaatttctttctgatttctgcaaaccggttcattctattcatcctattttaatcgagatcaatcacatccattttgaatgtatcatccatctccgcatgacttcttctcttttccggatgattacttaaaagatctgctgtcgcatcaaacagatcgtcatcatcataacctgctccgaacagatcataatcatcatcttctgaataataaccttcgaagttgtcaaatgcttcttcatccagaggtgtaaaggcttcaaaatcattggtatcctccagattaatcttcttaacaggtttacggattgccggacctgtctcgtctaaggcacggacacctttggatggtttcttttctctttcaggttctgtacgccttgctggctttttctgccttgctgattgtttcttagcaggcttgtgctccattgctttagcaatattctctgtcacccatggatcctcatcatcgaaatcatcctcataatcttcaaattcgtcttctccatagtcaaatcttgatgttttctttacagctgctggttttttagctgtctttttatttttcttcttctctttatttacttttttcgcagcttttttctgaatcttcttctctgcttcttcctcatccatatcaattccatattcgtcatacagatcatctaattcaagatctctgtaatgaagttttacagaagtaataattactacgatcagcagtactgcaaaaagaacaagtgcaataattactacgatatccaaaaaactatctacaaaatttaaaatttttccccagattccttttccgttattgacagtagaatctgacgctgaagatgttcctgatgatggcgaatatttctggtacgtaccatctgttgtatcataacggtatgttgtcttttctccatccgaattcatcgcatagacaatataatattccgcattctttgtatcctgccatgtatcaaactcttttccgtttaatgtaagtgatgtcttctgatactggcttggcaatgagatatttccgtcatcagccaaaggaataatatatctgccctttgcaacctctattacttcaagaggagcgaattttccggtatcactgtcatacagataaaaatccgcatctcctccgttttcaggtgtaagatacattgcaagtgcaccacttgattcctgcttaataatctgatgatctgttccttcaaatttcaacgcatctcttacaaaaccatcaggaataatcgtatccgaaaaatcatctgttacgatatattttgattttccaatcttaacctctgttccaccagcagccgaactggtatcttctttctgaatcagcgatttatcgccttctgctatgctgacagatgaagaacctgacgtaatctccaatgcaactccattgctatcaattccatcaaccttagcaacttctaccgatgttgttccctcatccaatgcctggaattttaagttgaattccatcgttgttccggcattttcatcatttcttgatattgtaattgttccgtctccacctgtagcatcatcaccgctgatgaagcgcagctttgttttatcatagcttaatgttgcctgaattgtatttaacgctttcgcagatgaaacctttgccgttacatctacctctgctccgacactggtctgcagatcagaaaatctgaattctgctgcggttgcacttgccacacatgtcattccaacacacaacatacacatcaaaagaaatgatacaattatttttttgacttttttcatgaataatacccctttttttatctttatggtgttctactctgtggtaccttcgccgccggttgattctccgcctgtcccggttgaagtatctcccgttgatgtaccatttcctgtcgttcctgtacttcctgttgttccgcttcctgttccggttgatgtaccacttcccgtacttgttccagttgtacttcccgttgtccctgtacttcccgaagtaccactgttaccactcgttcccgatctgtacgaagtgcttccggttgttcctgtacttcccgaactattctttgttgttccactgtttccggaatatgtctcttccggctgttgcataaactcctgcgttgattcgtctgtatccgcatctctgtttccggcttttttctctatctttgcactgatacccgatactgtggaagacacatcataattatcactttctccatagaagaaactatgcagctgctttacattactttccattgtaaccggaataacaacgcttcctacatttcccaatgtatcggttgtcttatcaaatgggaaccctgttgtttctcccagttcataatcaaacgcatctttcgcatattcaaggatttctgtcattgtgaagtttgtcgaaacctcaggaaagaccttatcaataatcttattcaactgtgccggtgatgccttttgcagcttctctacaactttctgcagaaccgcccgctgcctttctgcacgtctgaaatcatctccggccgtgtatctgattctggcatatgcagttgcctgcacaccattcagagtctgtgttcccggttctgtaactcccggagaaagctttccggtcaccttcataatctcctgaacataaccacagatgtacggcatttcatcttcctgtacatcgatatcaattccgcccacagaatctacaatgtctatcatcgagttgaaattcaccgttacataatgttctatattcatatccaaattcttatttaacactgaaagagcaccttccggaccgccatatgaatatgctgcattgattttattcaatgttccatcttcctgctctgacaatgtgtctctatatatcgatgcaattttcaccttcattgtcttcttattcaggcttgcaatcattattgtatcacttctggttcctttatccagatcattgtctcttgaatccacaccaaacaatgcaacgttcagatatccgcttcctctttttttggcttcctttgaaacgcttaatttatctgtatctaactttactgtattgatcttcgaaagtttactggctacaataacagctccaatcgctgctaccgttaccaatgttcctccaagaatggctccaatcttcttacccaaagaccaggatgcaaatccccttgttttcgaccttcgtccccgtcttttatatctttttttatcttttgccattactttttatatcctttcttcagccgtagcttatcatatcatatctatattaccttaaaatatgacaaacttcaatcaaaaataaagcttttcgtctacttttcccagtaacccggactcatcgaacaccatttaacgactttatccggcaattttttatacattttccccatccggtaaccaatgtacttacacccactttgataaaccagtttgggaaccagatgtattttccgccgttttaccaaatgagcggctgtctgcttcaccagttttattccttcgctttcagactttataccctcaaatacttccggatgttctgcctgtgacacagccatatcaaaattgcggtgaaactgctgcatccctgtataattatgcgagtgaatcactctcgcttcagccacataagcgaccttatatccggcatttatcatatgaccggccaatatcatatcctcattaaatattgttttcttgcagaatccacctgctttttcataaatattccgtttatatgctgcacaaacgttagaacagaagaatgttttaatgcccatttcctgtaaatcttccttgctttttatccggctgttttccgggtaattgaattttctggtatatttttctatataattacaatcagatgctgcaagctgacgtgcatacgccgccccggtcatttcatcttcttccagtactttcaccagatttccaatcacatattcatctgctggcactgcatcctgtgtcataaatacaacaatttccgcctttgacatctgcattcccatatcccgtgttgcgccatgatcaaattcccggcgttctatatgggatacttttaccttttccatctgctctacttctttcggaaaccttccggcctttgtattgatcacaaaaatagtgccgatcggatattcctgttcctgaagttttttcacaagtctgctaaatttttcatctggtctgtatgatggtatcaccacatctacagaagtctgatcgttattcatcttttctttttcatcctctatttcttatcatatcctacatagcaataaatcatccctgtaatgatcagccagaaccatgtcgcaggactgctgaaccatgttgtaaaaaatgcaagagccagatacactgcaatctgtccataaaaaagatatacaaccgggttatcactttttttaataatatcaataatgacctttgccacaacaccaataagcaaagctatcacaaatactccaatgactccaaaatcataataagcatcataaaacattgtaagcgttgtcaattcggtactggtcagatagaccgttgccggaaccagatttggcattacaaatttcaatcccgttaatgacacaaacgggaataacatccgcaggccataagaaaatttcggcagatttttcaccagacagtcaaaattatcgtagttattagcaatatagatatacggctgggtcagaaacaccggcatatgtgtatatttcattttaaatacattgttcaaatatatcgcatcccgcttctgtgacaatgtaatcaccacatacgctgcacaaaccacaaggccaagaagaaccaaggtacttttccgcatatttttatttaccagtatataaatgactgctgccacacctatttcaaacagaaactgaaatctcgatacatagagaaacggaactgcaaatgccactatatttgcaataatgattgctccattacgccacttactttcctcagaatcgatttttttccaaagcaccgtaagtcccggtatcaggatacaactgattgcacaataatgaagataatgtaaagccgacattctgaaataagaatacgaataaggttcgtctgaaaaaaccggaatataaccgatccggataatttcgattacaaaacatccggccgacacaaccagcagcaacataatacatcgaaaaagcctgtttgccttttttttatttttttcaggttcttttccctctaccctgctatactttcttccccattcatatcctattccaaaagctatatatatcacaaaaaagctcaaccaggttatatagctccatgtatcctgtaatgtactgagtttcagacagctgattccctggccccctacccaggcaagtgtaaacagagccctcagttccacaaagcttccactttcccttacccagtgaacatacaaataaacagcttccacaatcagaataattcccgaagcataataccattttgccagtgacgctatgtaactgacaaaaaagctcagcatataagttccatattctaaaataattttattccgttccctcattcagactgtctcctttaaacgtagactccattgcatctgtattatctgctgttatatccgtcagataaacaatgtcactgtcaatctcttttactttgtctgatgcctcataagaatcatcattaaacagttcctgatgtaattgctttacattctgttccaaaccgattggaatgacaaaagatacaccgctatgattcttcactgtttcactggttgttacctgatatgggaatccatttgttgacaccagattataattcagtgcattcgctgcaaatcccagaatctgttttgaagaaaaacttgtcgaaatcatcggaaatacttcatttactattttatttaaagtaatgaaattcgctttctgtgctttctttgcaaccttttctaatacaattctctgtctctgtgcacgtttgaagtcattaccacttgtataacggattcttgcatatgccacaccatgaataccgtccagatgctgtgtaccggctttttcttctatatccgaccaatgttctccaatcactcttgccgtctcggcaccatacagattgcaccagtgtgcttcttctttcgtcattttaatatcaatcccacccagagcatcaatcacttttacaagcgcattaaaattcacactgacataattcttaatatcaagatcaaagttacggttcagaagactgattgcctcttccggaccgcctgtattatatgctgagttcgctttatcatagcgtccattctgttgctgcagcaacgtatccctgtatacagacacaagcttcacgtcacttgtcttattattgatacttgcgatcataatacagtcactttgtacaccgccgtccaattcattatttctcgaatctaatccaaacaatgcaatgttcgtatactcacctgtatccttatagacttccagcttttttttattcaacacattataatccagctttccaagtttgaatattccgtaagcagctactaataaagcagccagaattataatttcaattgttagtaaaataattctttttctttttcttttgcgcaattttttttgtcgttcttctcttaattgtctttttgtcttgcgtcttttctttgccattgccgtctcctttagaagctaatatgcattcttattaataaaacctttgaaaaatgtcagaaataatatttttatatcaaatcccaatgtccaattttcaatataatataaatcatactcgattctcttttgaatcgatgtgtcaccacgtagtccattcacctgtgcccatccggtaagtcccggccgcacctgatgtttgatcatatatcttgggatctcttctttgaatttttctacaaactgaggcctttccggtctcgggccgatcagactcatatcccctttcaggatattgatcagctgcggtaattcgtcaatgcttgtttttcttataaactttcctaccggcgtaacacgcggatcgttctttaccgtccatccattcttttcttttgatgcatcctgtacaaccatagaccggaatttatacatatagaatggtttattctgcagaccgatcctttcctgtttgaagatcagtggtcccggagatgtcacttttataataattgttattaccagcatgaccggtgaaaataatgtaagcgcaaccaacgctccaaaaatatccattgccctttttacaaatgcattcagcatattgctaagcggcactcttcttatattaattaccggaagtcctaccaaatcttccgtatatggttttgtcggaatgatattattataatccggtataaactttgtatgcacaccggatttttcacacatacctacaatcttttctaatttatgatattctgccagtccgagagtgattgctatctcatccagtttattttccggaagaacaatcataagattatcgattcttccaagtaccttaattcctttatactctgttcctcttggtacattatccgcaagaattcctctcacgatatatccccattccggatttgctttaattctgtcaatatactgttccgccgcacggctatatccgatcagcagaatgtgcttctggttatatccctgcttccgcatatcccgcagcacttcacggataatatttcttacaacaacctctaaaaatacattcaccaggaaaaatacaaaaatcattccccttgaaaaatcaggctgcttccacacatataacagtaaaataaatgccatcagaccaattacattcgcctgaatgatatgccatgcttccagtctgcgtccctgcacacgttttggtgtatataactggaatccataatataagaccagatatcccggcacaattacaatcaacacttttgcatattcctgcaacgataaaaaccatggatccaattcaaaaatcccgcttttaaatctcaggtaccacgatgcaatatatgaaaatacaattacgactgcatctattactacatgtaatctgtttaataacttttgattatcctttatcaatgttcctcacccatatttatctaattttacattacgttttatcttacaataattttttccttacggcaacccattataccacagtttttcttaatactttattaataattttgaaatatatttaaaaaattattttacccaatcttcatatggcaccctcttcttttttttgctataatagacacaaagcagaaaatagagatcggagtatttctcaaactatgaaagtaacaattatcatcccaaactataacgggaaacattttatggagccctgcctccagtcattatcagaacagacctgcagggatttcaaagtattagtggttgacaacgcatcttctgatggaagtctggaatatatgagtgagcactacccagatatagaagttatctccttaaagaaaaattacggtttcagtaaagcggtcaatgtcggaatcgaacattccactacaccttatgtgatattgctcaataatgatacgaccgttgatacacactatgtagaagaaatgatcaaagcgattgaaaaatctccgcgcatcttttctgtcagcagtaagatgatccagatgtatcatccagaactgatcgacagtgccggtgatctttatactttaatgggttggggcgtgtgccgcggaaccggacgtcctgtctccaattacacaaaagcagatcagatatttaccgcatgcgccggggcagccatctaccgccgaaatgctttttcaaaaatcggcttatttgatgaaaaccattttgcataccttgaagatatcgatgtcggataccgtgcaaaaatttacggctacaaaaatacatactgtcccacagcacttgtctaccatgtaggaagcggtacaagcggttcaaaatataactctttcaaggttaaactatctgcccgcaacaacatttacctgaattacaaaaacatgcctttcttacagctggttttgaactttattcctctttttctcggctgtgttgtcaaatatctgtttttcatgcataaggggttcggtaaagactatgcctgcggaataaaagaagggctttcccatgcccgggaacagaaaaaagttgcttttaagctgcggcatctgcctaactatattttgatcgagtttgaactgattcttcatactctttcttatgccagagactggtttacacgaaaattattcaaaaaataaaaaacaggaaccgtatcattttacttttgatacggttcctgctttttattaaaatacatattgatcatcaataatccgatcatctgaaatccattctgtagtccgagaaatgcaggattaaatacaggtcttatcacaaaccagcccaatccaatcaaagtaaatactttaatgacccaggtgttttttctggcatactttacgattttttttatgtatatcaggagaactcctccaacaaaaactacaaatcctaaaattcccatctggtaacaaaatgacagatattctatttcatatgaaaacggtatcgatccacttcttgtataatcacttatgtaacttccaaatccatgcccgaatactggtgactccttcactccgtttatcaattctatcatttgtatctgcctgacatcatctgattctatagcaaatgaagaaaaaaaccggaattctatcatttgtatcacaggcttcaaccataataccgacgaagcaagcacaagaatcaccccgatgcatcttaccttcttcgggattttcttccaataatataacactgcaacaaacgcaaagcagcagaattcaaccatcaaaactctcgaaaatacaatcaatgtataaatcccgctcaatgcaaacagcagacttctgatgctttttttatatttctccatcatccagtaaaacggcatcagtgttacaactataatatcggatgaagtctgcacacggatcagcaataatctgcccaaatgcattgtcatcgtcgatgcttccgttccaaacatgtttagataaaattctattacagcctcatattctatcaacttacatacaaagacgatttctatgattatttttcccagaatcttcaaaagcatcatataaaggatacattctacaatcttttccggttcagccaattcatatctgaccagaaaatacaattctacaaacacaattaccgagatataaaataatcccgtaaattttatgctccattcatttccaagaatgtaactgactatacatgccaacaatcccaaaacacctaaagtaatctccagcttcgcactttttataatctcaaggctttttctttgtaaaaccaggcatattcctcctagaataatcaacaggcataccaatattttctgaattggtatgcccttcattactcccgttggaagtgcataacttatgatgcacagataaatcacaacattcagtaattttgataacttattcatagtttatcctaaaaatggaacgtatctttcagtccaacccacagctgatccttatcacttaagttcagtgcagtgccgtcttccagcgcataaccttccccggatgctgttcctttatactctcctgtcagtgtcggccactcaataccgatctcaggatcgttccatgcaagaccaccttcgtctcccggatgatagaagtctgtacacttgtagcagaactcggcaagatcacttaataccaggaagccgtgtgcgaatccttccggaatatagaactgtttcttattttcttctgtcagttctacaccgaaccattttccgtatgtctcactgtcacttcttaagtctactgccacgtcaaatacagaaccttttacgacacgtaccagttttccctgtggaaattctttctggaaatgtaatcctcttaagactccctttgtagaacttgactggttgtcctgaacgaactgcattgtaagtcctgcttcttccatatctttctggttatatgtctccataaagtatcctcttgcgtcaccatgtactgttggttcaattacacagagtccctggataccgcctgcgtttttttctactttaatctgtcccattattacgtctccttattgttttaaatgatttatacgtgagttaatcccagccacgtcatgtggctgagattattcttcacctatataaaatttagaattcgatttcttttagatatcttccaagcgcatcctgccatgtcggaagtggagtaaatccattttccacaagtttactcttgtccagtctgctgttgaaaggtcttgctgctttggatacaccgtactcttctgttgttaccggcagaaccgtcaccttgtcttcgccgtattcgtcatggccaagctctgctgcctggcggaagatttcctttgtaaaatcataccagctgatatatccgccttcatttgttgcatgatagtaaccatatttgtcagtctcgatcatgtcaacgagaagtcttgcaaggtcaaatgtataggttggtgttccgatctggtcatttacaactttcaatgtatcgtgtgtctttgctacattgagcattgtcttgataaagttcttaccgttctttccgaatacccacgcgatacgtacgatgaagtacttatccagagtctcagatacggcaagctctccggcaagttttgtctctccatatacattcagtggtttgtaatccttgcagtcaggttcccaggctttctctccctgtccgtcaaatacatagtctgtactgatgtataccatcttacagtctaactttttacatacatctgcaatgttctttgttcctgttgcattgaccgcttttacgatgtctttcttatcttcgtcttctgcaagatctacggccgtccatgcagcacagtgtaccactacatccggttttgcatctgtcagaactttttctacagaagatgcatctgtgatatccatcggcacatatggcattgttgttaccgctgtaccatcctggattccgctgtatgtttctttgatgtcagaaccaattccctcataaccacgggatgccagttcgttcatcacgtcatgaccaagctgtccgccaacacctgtcactaatactttcattcttaaatctcctcccggtgagcatacattttctcataatagttctggtattctccggaaatgatcgtctcccaccattccttattttcaagataccatttaatcgtcttcttaataccatcttcgaatttggtctccggaagccatccaagttcgttgtggatctttgtaggatcgatcgcataacgcatatcatgtcccttacggtctgcaacgtgagtgatcagactttccggttttccaagctctttacagatgatcttaacgatctcgatgtttgtcttctcattgtgtccgcctacgttgtatacttctccgactcttccgttatggatgatcaggtcgattgctttacagtgatcttctacatataaccagtcacgtacatttaatccttctccgtataccggaagcggcttgtcattcagtgcattggcgatcatcagcgggatcagtttctccgggaagtgatatggtccgtagttattggaacatctgctgatagataccggcagtccgtatgttctgtgataagcaagaactaacaggtctgctgctgccttagatgagctgtatgggctgcttgtgtggatcggtgtctcctctgtgaagaacaggtctggtctgtcaagcggcagatcgccgtatacttcatctgtagatacctgatggtaacgtttgataccatactttctgcaggcatccatcagtacagcagtacctttgatgtttgtgtccaggaatacttccgggttctcgatagaacggtctacgtggctttctgctgcgaagtttacaaccatgtccggtttctcttcttcgaataatttgtacactgcttcacggtctgtaatgctttcttttacaaaacggaaattcggattgtccattacaggctccagtgtagataagttacctgcatatgtcaggcagtccagacaaacgatgcgatagtccgggtatttgtttaacatatgaaatacaaagttacttccgataaatccggctcctccggttacaataattgtcattttttgctttctcctttttttatcatttcttagtatagattttagtacagattttctttatattttccatccaggacatcttttaagtactgtccatactggttcttcttcaggacttcatatacttccattacctcgtccttactgatccatccgttcaggtatgcgatctcttccaggcatgcgatcttacggtgctgatgtgtctcaaccgtcttcacgaagttggttgcatctacaaggctttcgtgtgtacctgtatccagccatgtgaatccctgtccgagaagttctacattcagatcacctttttcaagatatacacggttcagatctgtgatctccagttctccacgtgcacttggctttaactcttttgcatacttcacaacattgttgtcatagaaatacaatcctgttacacagtagttgctctttggctgtgccggtttttcttcgatggaaatagcttttccctcgtgatcaaattctacgataccgaaacgttccggatcatctacataatatccaaatacagtagctccctttccggtctctgcattctcaacagcagctttcagacgtttattcagtccatgacctgcaaaaatgttatctccgagaaccattgctactgtatcatcaccgatgaattcttctccgatgataaatgcctgagcaagtccgtccgggcttggctgtactgcataagacagattcacaccaaactgatgtccatctcccaacagttcttggaatcttggtgtatcctgtggtgttgagatgatcaggatatcacggatacctgcgttcatcagcactgacattggataatagatcatcggcttgtcatagattggcagtaactgctttgatgttaccattgttaatggatacagacgtgtgcctgaaccacctgctaaaataattcctttcatttcaggaacctcctcgttttgtataaataggttatcaagttctttactttctattctagtctccatgttccgtgttaattagattataaaaggtgaccttaggtcaccttcaagtactttttttatttttttgtaacttttctgtaatatttaagaagttcttaagaattacttctggtattcatctctaatgtggatactttttggttggcagcttatgtcctatatgccctatatacatcttcttttgtgttgtatccggataaaaaaatattcttccggcatatcctccagtaaaccttgtatgccatgaaaacagttgtgcatttccttccggtaacaaaaaagtatgttccgtctcatattgttctaatgttagcggtgtttccggtgaagctttaggtaaaagcctcttgtcaaattggtttcccattttttcagctgccacctgtaattccaacaggcgtttatacacttgtcccgcttctgcaacacctacattcttataacatccatttatcgcattttcacaaaagattaaattcggaaatctagtctctttacatttcaaaacatcttgtgctgaccggatctctgcacgccactctttccttttttccttgtacttttcttcaaaaggctctacattcttctgacacgatacattcgggacctgtacatgttcttcctttaactcgtccttctcattaaatgtcacataatatccactaatctcaggggtttcccaatagtcatcactcaaaaaactaatcgtcacgccctctgtttcatatgccagcagacatccctttgatatatatttcttcccttgaatttctagattgaattcgctttccaattcaacctccgaaggatcatatatcacggatttatttaataacgctcggaatcttctctttgtttccatatctacaaccggatcatttctccactgttctattctgtaattttttgccaattcaaaagaacaataattctgatccataagcacagagtcatttataattattttcttcactttcgaatatgtattcaaaaaactatccataatctgtctgccctcggatattgtatctaccggaaattttgcagacaagtcatttattatcatttgcatacttgtatcctctagaacaattcatcaattgccctgtcccattcatcaaagaacccttccggccagaagctcagtcttccatctttatataagaccggattatcaataactgggatagaactgtattcttctgtatcggctttttttctggaaaaataatataggcgcactatatccggatcaatcatattatgttttgcacacaaacgtattccattcaaaatatgatcactatgcgtttctacaataacctgcacacctccctgtgctgctctggcgatcagttctcccatttttctctgtcctcttggatgtaaatgcgcttccggattctccagaatgattaattctccctttttcgccttcacaagtgccagcacaattggtaatacataagaaataccaaaaccaacattctgcgcagtaaagtagtctgctcctatatttccctcctgatgcaccataagaccaattctgttgctatgtccataatcttccattcgaagagacacacccggcgtaatctcccccagccaacattctacctgtctttgaagtcgtctactcggttcctcatcataaagaatatttttattttcaacttcttctgactcgtgcgtctgtaaatagtgtaccgcatactctccatgatttccgatttgttcctgttcccagacttcgtaatatgatttttcataactactttgtggtcccagacgatccgccgcaatatagttaaatccacttccaaacaaattcatatctttaaccatatttatgtctatattttctaataatttcagaaaatctgccataccattataatcatattctgccgacagcatcgtactttcatcgcttattttcatttttatgcgattctcttctgcctctgtatataatacatcttttcccacaccaagatttgtatattttccattcagataaatgcccttttccaaagcattctgttcatacgactgtcttaacaacaacagcatctgtattatcgtagacttccccatactgtttattcccgacagtaaattcaaattagacatctccaacgaaatatctttgaaacatttaaaattcgatgcttctattctttgtatcatctaagactcctctcaataaattctcaattcttgtaaaccgaaataaaaaggattttttatcacttgctttaataatctgcaaaaacacctcatcattacaaagtttcataaatcttttatatacttctttcttttcttctgctaatttttttaattccgaatcatttaacacaaacatacttctgcaccatgcttcataaattgctttattaatcgggcggcgcattccattctcccctaattttcgaaatgcatattttcccatgataattctggaatatctcatcacacgtatgaactgctgctccatcagttcttcatccacacattctttggaattcagaaattccattgctccattcagataattatccggtactccttcatatttttcaattccataatagcaaaccgctataaatctaagaacaaattcctgatccatcatccggtcttcttttatgctaaaggtggttgcagataaaaattcctgtatctttgcaaattttttacatatctttgttgcattcccctgatataatgcatgccttatttcctgtggttttaattccagtccgcctgtattaattcttttaaatatattatatttcacatttaccggagttccactttttacaatataagcgacaatattcgtctcttcaatacgtcttacaaacgctctcggaagttctgaaaatgtcaatccattcaagtcactgaagaattccagtccagtaagcttcagcgtcttatcaatcacaaactctttcaatgccgtaagtctttgaagtccatctataatcagccacgaatcaacaattccaccatcaaaataaaaagccggaataggtattcttaaaaacaaagactctattaactgacttttttgaatgtccgtccacaatccaccctttctctgaaaatccgtattcatatcaatctctttatattgtaagcgcttaatcaaacttgataattccattgtcttcatatcgatatcaatcttacttggatcaaacggacggatcatcggtattgtctgttcatcattttcaacttctgcatcctgttcctgaacatcatcgataacttctatattcatcttacttagataagcttttatccgattgtacatctcctctgtctgcttttcagatgataattctacccagtaattgctcacaagcatagaacttatctttcctgactgtttttcaccaatttccaccaacaaatctaagtcctttttttctttttcgctaaacatgtatactctcccgtttccgtgcatataatattcaacaactaatagcttaacctttaattattatacttcctcaaaggattattgtaaaatggaatctgaatacgcaatcaaaatatccctcacaaaacatatacatgacaatcccatccgtccatattactggagtttaataacatatacgacccaatgggttcagattatcggtggatgggaatcatctcctgcagcctgcatggaaaccgctcttaagtattatcagaatcatctccaatcataactttacaatccttcttataacatgcaattccgtattttataaactgccgcataccgtcctgcttcagtcttgccatataatccttttcttcaatctgctgcaattcaacaaccacacctgtgcggtctttcgggatctcaatcaggatatcactgtatccaagttcagatacccggttgtaaaaagaacgctccacagattttctattgaactatctaattcattataagtcagatcctgacgaatctcctttataatcgattctccggcgatcagctgctcaatctcatttttcgtccggtaatccgccttatcaataaaacgccgtaccatagcgtttccactggtattcgaccagtagtcttccggcagtgcattgatatccgcacaatgattcttgcaataattgatcacatcccacggacagtatacatccgtttcaccgaactggtatccgtcataccattctttcacggtatcgtagcattccttaattccatagtatgacaacatttcttttacttccgtatctgtaaatccgaaatattcatcaaattctacattggtaattgaataaatattaaaattattgaatcccataaatatactctctttcgaaacacgaagacagcctatcagcaccgcaaagaacaagttcgaattcgtctttaatgcattaccaaataatccacggatcaacattaccatctcatcataataaccatactggaaagctttatccaatggcacatcgtattcatcaatcaaaatgatcacttctttaccgtaatgctttgcaagcagttcagacaatacaagcaaactcaccggcatccagtttctcactttctgtcagaaaagagaatcttctgatttcactcccaaccacatactgcattgcttctctggctgtctgaaagttctgtccttcgattccttttaagcttatagaaatcactggaaactttcccatatatttatcgcataattctttttcttcagaaatctttaatccttcaaagacggatttgtcacttccgatttcaaaaaagggttggagcatattcatattcaggctttttccgaagcgtcttgggcgggtgaaaacatttacctttgcccagcttttaagaagtgccgcaatgattgtcgtcttgtctacataataaaattttctttgattagtttttcaaagttctccacacctaccggcaatttttccctgttattcatttattcatgctcactttcttgccacatttcaaaaagcgcatttattaatgcatacatttattttattatacacaacatttttattattctcaaccattatacccaacaaaaatcccagcatctttcgtaatatgaaatccgccgtccgtcttcttccgcacataagactggaactccttgtaatgatctaggatatactgtccctgatttccatggcacgacaagatataagaaatcaatggctccggttccggcacgataagcgaatcctcataccgcctccactctatcttttcaaaatccttctgaagaatctcttctccgttctcttttccaaaacgctcgtacagattctttgctgccagtacaattcggtcatcgaacttctgtaccagttcactcacttctctcatatgatcattgccatatgtactgcagacaaatcttcctcccggcttcaatacacgttttacttctttacaaactttcgggatatcttcgcaataaaacaacacatgattggcaattacaagatcaaatgcatccttatcatatgggattcttcccgcatcaaatacacggaatctgaacctgctgtcgtctgcaccgatcgtacgccttgcatctcttaacattccatccgatatatctgatactacgatctccgtctgttccgggatcttatccctgtccacgttccagagtgtaccatctccacatcccagctccagaaccttcattcccggctttaattccaattgttcgaaaatccatggaaaccatcctttcgtattctgcgaatacaggctatgtaggttaattcttgcggaaatgtttgatgcatcctgatactggttcttcatactcttctccataccggtcagatggatcagattcaacatctgactccagtcaatggaatgttctttctgtatcagatccgacgtatcctgaattgcctgctccactagttgcatctgttcgatgcggtcacggactaattttaactgaatgttaagagagttgagcataaagtggtaatctgcatcatcaatcgtcatatcacgaatatcatccagggaaaatcccaaatatttcagaagtaaaatctgctgaagtcttgcaaagtcttcatctgtgtagaatcttgcgcccgcttccgtgacataagatggttttaatatattctgtttgtcgtaatagcgaattgtccgcagggtcacatgggccatgcgggcaaattcaccggatgaatagtagcctggttttttcaacttactttccttcctacttctttacaattgttccaatttttcttaacggttttgtcagcttccatgaagttgaattttcataatcttctatgatcgcttccaactcttttattttattatctctgtctgctatgtctttttttaacataagtttttgctgttcatttcttcgtatttcattttcaaatacttcttcctttttctttatgttttgaattatttcttgtactttccaatcattataaagatgttctcctgttaattcataaaacttttttatatttaattcatatttactttccaaaatatctgccattattttatcttgaagtaagtttatcaaatattctataccaacatttgatatagttcttccctgtcctacaggactacacaataaaaatgctttttcacattccaattcttctcttgattcagcattattatttttaaaatattttccaaatgtttttttcaacactacatccgacatttcatcaaaaaaatgtcttctgatatccacatattcattatatgttctagtcatattctcttccgaagtattactattatttatttcattatcatatcttctcattctaactaattttttacttatcacggccatcggacatttttttgcaaccctaacccaataatcaaagtcatgtaattgtctatatgcaatattaaattctcctatttctaccataagttttgttgtcataagtactgatgtcattggtaaacaattcccaataaagaaaaatgtttccaaccattcctcttgactttcataatttactgcatataatttttccaactccgagtcaattatttgatccttctcattaataattgctgcatgcgtaaaacagattttttgttctgaatgatttttcaaatattccacttgaatctctaacttgtttttttcccataaatcatcactatcaattcgtgcaaaatattctccgcgcacttttttcattccaatattagtcactgcacatatttgcttattttctttttcttcatacaactcaattctcggatcttctatactatttataatttcaactgaattatcagtcgatccatcatcgacaataatcaattgaagtttcgaatatgtttgctccaacacacttcttatcgatttttcaattgtgtccgcatgattataattaaccatcaatacacttacaagatcttttttcattattgtccaattcctctccgtcaacacatatatattatatttcaatctttattctttgattttataatattattaaatatctttttaaaattcaaacatataatccggataatcattatgccccgtctctaaacaatttccatcaacagttatttttattctatccgcccgatatgcttttataaaagtattgcagattccaccaacaacataatactcttgcgtagaaccacacgacataatatactctttaaatttttgatcaaaatcaatgtttatactctgcattccgtcaatttccgatacttcaaatttattaatctttatatctttatctattactcctttatccgctaaagcattcaatacattttccggtgtaagttcttttatttttaccatatccgcagtaaaagcagttgcatcatcattactgtaaaacacactgattgtaacatctttttttgtttccgtttctgattttgattctttattttcgtcactttcacttgttgtatcattatcctgcgtttctttttcttcttttgcttcttttgcttcttctttgtcagaatccttcttcgtattgatttctaatttttcttcctgctttttatcttgtccatttttcgaaatgtcatttgtttttccgctttcattacatgcagttaacattgctatacttaatatcgtaattataaatattcttttcttcatgtttccacacctccccatgtttttctatttatcggacttatatatttctattataaaataattcctgacttttcacaatgaaaagtcaggaatatgcatcttaactatttaaacaatctatataagaatttaacaaaaaatacaatatataacacaaacagtaatactacgcaaaatgtctccatatcaaaacggttcgttactgtttttgcaatcaatgtaccatcaacattattaccgttaattaagagttcagttcctttttctgtctttggttcgtaagagaaaccaactcctaatgttttctctacatcaccgtcaggattttctacatacagcgtatatgtctttcctttacactctgaaatcctgtcaaatctaaaaacattaaacttactatttttaatgtcttttaatttcaattcagtttttgctacaatcttgcctgtctcatcatcttttaataaaatctttactgtagaatctgccggtgctccttgtatggaacatttgattgttattccatccagatagtcctcttccgacacaaatttctgttcaatttttcccgaaagcactccggtacccatatatttactggtatctattctgttatcatacaaaatatgcgttttggcaatatgcgcatataaaaagctaaacattataattacagctatgccaataacccatttcattattttcttcattattggtctcctttatgaatttttatattcactacaaattggctccgcatctccaaatcgttttaaaactccatgatccaaccaaacaactttattgcatatcgattctacctgttcaatactgtgtgagacgaaaagaatcgttgttcctctgtccatcatacttctgattcttgcttcacatttttgttggaatctaaaatctcctactgaaagaacttcatctacgatcataatgtccggtgtcccaatcgtcgcaatcgcaaacgccagtctggataccattcctgatgaaaaattcttaaccggaacatccataaagttttgtaattctgaaaattctacaatttcatcataatatgaattcatcatttcccttgaatatcccagcagagctccattcaggaaaatattctctcgcgcagttaaatcaaagtcgaatcctgctcctaattcaatcaacggtgcaaccgttccaaacacacttacagatcccttagttggtttcaatactcctgcaatcgtctttaacatcgtactttttccactaccgttcaaaccgatcagacctaacgactctccacggtatacttcaaatgacacatcttttaatgcccagaattcattatatgacacttgcttttttaaactctttataatatattctttcagactgtcaaacttctcagacgcaagattaaatttcatagatacatgatctactttaataattaattctttctccatgtcatactcctaaatatttaaaataaactgatcctggtttctatagaatacataaaatccaataatcaagaatacaacagtttccacaactgcaactatcagctgacctatactgaacaccatgttattaatcattacatctctgaacatcatcagaatattcgtcaatggatttaacataacaatcttatataaccatcccggtaaaattgacatcggataaatcacaggtgtcaaatacgtcaatgcggtcagaaatacagagtataaatgcataatatctctgaacttgactgtgactgctgataagatcataccaactcctaatgagaacaatactaataacatcagcggaattggtgacagcattactgtccagtgtaattccgaacgcatagccatcataaccagaagtaatgcagtaaatgaagccatcagattaataaagcttgaaaatactctggaaataacaaataagtatttcggtacatatacctttttgatcaatgctgcatttccggtaattgcagacattgcactcgatgtagattcactataaaaattaaatacaatctgtccacttaataaatacagcggaaaattttcaacatcaaatttaaataagtttgaaaatactacagataagataatcatcataagcaatggatttaacaatgtccacagcacacccaaaaccgatcttcgatatttaattttaatatctcttgaaaccaattcacttaagagcggtctgaatttcaaaaaattttgtatatatcttgacatattctcctccaaaaatcattatttacaaacgacaatatattttagcatattcttttctaaatctcaacctattagcaatattctgataattaattgtataattcttaccaaaataataggcggctgatgtatttcatcaaccacctatattcattattaatgatatactaccactgtacttcctgttggaatagtatcataaatccattttgcattattaatatttaatctgacacatccatgtgaaagtggcattcccagtcttccatccattaatgttccatttttattgtacaaaactgaatggaacaaataatttcctctgaactgtgtataccagtaacatctcgccgaacccgaatcaaaatagtaacctttacttcccacctggaatgttccttccacagttggtgtacttggtgctccatctgaacagtcccaatactgaatgcaacgccagtttccctgccatccctgatagattcctactttatgtgtacttctgtttaccagtaacaagtatggggttctgcttgaatacatatttgcttttgcattcataaactgctgtgctgtctggattctttccagtgagtagcttgttgaaccaactgcacttcttacaccgttttttgcgacatatgcatgtgtattgtattttccaccatgcttgtgattattactgtctacagtaacactccatgtaccgttccctctgttaacaccactataccaaacgatatcatcctgaccgtttgtttcactccatgtagggaaaagtacttgttctccatcagctcccaaaagccatatttctctttgcgttccacttacatatctattatatatataattctccgcattaattatttgagaagttccacctacacccgaaaaaataccatttcccatagttgcataaacatttatcttataatttccaaaatgataagcatggttcttcacattcattatagcagaatatataccttctgcttcttttattgctgtataccaaacaatatcactctgattatctgcacaccacataggaatttgcactgtttgtacactagatggtgcaaacacacctgaaacagtcactttaaaagttcctttgtttccatttacttccgaaacctgtattcctgcacacttcgttgcctggctaacattaaatgtagtgcttgcaattccctgcaattcattattccgggttatgtaataggcattaacattatacgctcctaattctttatggtttgtaatagatactttcaatccataattatgttttcctaaattttcagccgtgtaccatctgagatcattctgtccacctgcatttccccaaacggcaaaaagcactcctttttctcctcccggaactttcagattattcaaattcaattgatacacactctcagaaccgtctatatctttcgctgtaagattatcataatccggcgacatatcacactgcgttccctcaactcccgtaagcattcctgtaatatctgtcatatatacatcaatccagtatattccactatgatacttatgattctttatgttcgtttccacaacatattcatttttggcattctttttggctgtataccataccaaatttccctgatttttatcagaccaaattggaatcaatatattctttatcaatccggcattcttattaactggaactgttatctttaacttaccgctttccttatctgactctacttgcatttttcccaatgctggtgattcaacagaaatattagtatttcctaaccccattaaatttccatttggttgaaccgcatacgcattaatccaatatttgcctaaacctttatgtttagaaacatccaaatttatttcatattgatcttttgcattctttttagctgtgtaccaaatcaaatcatcttgtccattgacctcactccatatcggaaccaaaacacttgtcgctccacccggaacttcaaaatcttttatggtcacaagataatttaatccatctttttctttgatgtctatgcttccctgtcttaacatcatttcagtttccagactgcttacaccatattgtcttcccgtcacatctgtaatataaacaccaacattatattttccaagagaatatttgtgtttctttatgttcacatctaccacatattcatcgctatccgacattttcttggccgtataccaaactagatcatcctgtccattcacgtcactccatactggaaccattatattatcaatatattccgcatttttaatatctgataatcttattaaaaatgtaccactttcctgatttttatcctcaacttttattgttccaatctctggattattgacaaaaaattctgacattcctaatttaattaaattccccgttttggtttctccataaacgtgaacattatatttccccaatcctttatgattacgaatatctacagttaacgaataatgattttcatctaattttttagatgtataccaaatcaaatcatcctgtccatttatatcactccatacaggtattaatacgtttttaatgcctcccggtattctcacattatccacgttaatgtctatttgtaatctgtcttttgcattttgtttaatctcagtttcgacatcctttttttcaaactcaaaagatgttccggcaataccaatttgcataccatcagtattaattgcatacacacccacattgtatttttctaactgatatttatgattagccacactgtctcttactacatattgatttttatcattttttgttgcaataaaccactgcaaatcatcttgcccatttgtatcacaccagacagccatcaacacttggcttatcttttccttattctgtaaatcagataatataattgaaaacgttccatccgtttcatcaatatcttctatcgtcaccttgccagttatagcagccttatccacttgtacagtttcctgttcctgtaatccatcattcgctgttatctgttcttgcttctgcacataaccaatatcctcatctgtcacactttcgccaacaactacctgtcctttttcatcatcaggtgcatcagcataactaactacagttccaactgccaagcaaaacattaagcttgcaatagcaatcaatctttttttcatacagccacctctttttcacctttcattcctcgaattctaaaaatatttgctgaataaaaatattttcagattttataaaataatcatatcatctttttccatgtttgaaaacaaaaaatgtcttgtaaaatgctttacttgcattttacaagacatttcttttaacatgtctttaaattttttatcatattcaataacttctccgcatatcccgcatctgtagcccaacctattccatatggattgttcgctttacttaaccattgtacataaggcgccttatttctcaaccaactcccccatcgtggatcaacacatgggttattcaatgctacatcacttgcgtaacatttcaaatgctgtatctgtgctctaattccttcgcgtacatcactgaattcgtttcccggaacacctcctgttgcacctatgccggcaaaattatactgattaggttttacgtccccaccaaattttaaaaatccggtttctagcatagcctgtgcaaatgcaacctctacacgaacaccttctgcttctgcttcttgcttaaaaattgtacaataggtttctatattagcagctcctccttttgccaatactccattatattgacttaagcgacccgaatactgatcatatgtcagattattctttttataatatgtaaccatctgagcaatcgttacatccgaatgtcccattattgtatataatcctgtattttttatttcctgcgtgcagccaccaattcctacttgcattccgtttccagtttccaaataaacatttattttatatgttcccgcatgctttttatggtttgctatattcacagtagctttgtatgttgtactattaatttttgttgcctgataccataccaaatcactttggtcacttgcacaccaaacaggaaccatcacagcctctacaccagatactgacttaatattatttatcgttacattgaagtttccactgctctcgttatattcagacacactgattcccgctgttggcctacttacattgaaggtcgttgttttcgtcttcacacttccgtttgccaatgtaatatatgcatgtacattatacgttccaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaccgtcaattttgctgtcggccggcttacattgaaagttgttgtctttgtcttcacacttccgtttgccaatgtaatatatgcatgtacattatacgttccaagtgttttgtgatccttgatcttcactgtctttgtccatgtaccggcattctttttctctgctccgtaccagatcagatcatcctggcctccctgtacgctccatactgcaaactgtacctgacgaatatttccatacgccgatgcattacccaaggtaacctgaaattccttttctgttcctgctgtatcttttacatttaaatatgtatttggcagtttcatctcacatgtagtagaagcaattcccgtctgaattccatttccgtctacaatatagcatgcaattcgatagattccttcattataattatgatttcccatatcaattgtaatcttatagcttccatttgactgtttttgagccgtataccataccaaatcactttgatttccctgactccataccggaaccaacactgaatttattcctgatttactttggatattacttattgttacttctgctgttccatttgaaccattttgtttttccaccgtaagcttcgctgttggtttcgtaacattaaatgacattgcttttaagaatacacttgttccatcgttcagtactgcataagcatgtacattatattttccatatcttttataattctttacagcaatattggttgaccagacatttccactttttgttcctgtataccagttcaaatcatcctgtccgttttgatcactccatacagcaaactgaattcgatttaacgtatctggaacatttgtaatttccgcagaagccttaaagtttttttcttctcctgttgtatcctgaactttacaatttgcactactattgtacatattacaggtcattgtttgtacacaggttactttttcattcttatcacatttataaatgtgtatattgtatattccatctgcatttttgtaattagtggtattataattaatctctacatcatttcctgattgcttattaactatagtccataaattatttggatcttgaccgtttttatttgaccaaacagcaactctgtaactttcaccatctgaaagctttccatttatctttaccgtaaatgttcttgcaaaatcatttttctttataactgatgctgtaaatttaccagaatcctcttcttttgacaaattaaaatactttgcaattcctgtagcatcagcaattcccactttcttaataaagctttcctgcttcaacttttctgcatctgcagaatttgttaaaaacgcatgttccacaataattccagggaaacctgctaatttactatttcgtataacgctataataatcagcaatacttccatctgaatatttcgaaccactttcagaatttcgtatttttacacctctgtttgccaatcccaagctaacaagttcattttcaatatctgaagccaacttctgtccattgttatgtatttccgaattatagctactattcggataccatacctcagctcctgttgccgccgggcttgccgaattcatatgaatacttacaaatacatccgctccccagttttttgccatctgtacacgttcttccagtcctaccgcaacgtctgtacttcttgtcatatataccgtaacgcctgaatatttttccagttcttctttacaatactgtgcaattttcaaagtaagatttttctcaaccagaccattagcagcggcaccaccgtcacttccgccatgtcccggatccaatactacaactttattccggcttcttacagtccttccttccagactttccgctgaaattgctgactccgtttcactcaatgttgatgcaatatctgttgatgcagaaactaactttccagactctacatcaactaccgatgcttctactgcctgttccgcatttgtgtcactgtttccagcttcatagccttcatacacttcatctacaccaaactttgcattaacacctattgcttctaaatcaacagagttctctacaccattcagaatatacgtaaatgtctttgcactgtaaacacctttttcttcggcagaaaaattatatgaaaacaggaacaactctgcatcttttttcccaaatgcaaattctgttacagttccatcacttttttgaaagcttaatcgtggctgttcaatattttctgttccttttccaaacgacacaactacctgctgttcccccggactttgcagatatccctgatctactgccagataattaataaccggctgttcttcgtttgaattatctgttaaggtgctattttcttctacattaccaacttgattctgtgtatcactattctcattttcataattaacacccgaatcatcctgtgatattgtgtttatatcttcattatcattttgagtttctactgttgtattactgttctcctgcacctctgcagctaccacgttaacacttcccgcaacagttgaccaaagcataagtgcagataagaaaactgctatttttcttttcatctttttccctctcttttatttatcccaacgtgaatggagccttatcaattggaaaattcggattgtagaacggatctcctttttctaatatttctggccatttcttctggaattttgcaacttcgccctcaaagcgctttaatttttctggtgtatcctcatatcctcttgatttcgattcataatggtaccactctgaaaatgcattaaatacaacccacttaccagtttctcttactttcagacagtagtctacatcattacatgcaacaacaaattgttcatcgaatccaccaacctgctcaaacagttcttttttagtaatcatacaggctgctgtaacagcgctataattacagttaatctgtgctctgaccatatatccataatcatctcttcggattcctatatttacatgtcctgcatatccgccgaatcctactacaacaccagcatgctgtactgtatcatccgaatataacagttttgcaccaacaacaccgacatcttctctcatacagcatcccagcaattcattgatagctgtcggggtaatcatctctgtatcgttatttaagaagagtaaatattctccttttgcaaagctcacaccgtaattgttaatagcagaataattgaatccctcttcccacttgaccacttttacattctcatactctttctggagtttttcataatatgcaaaagttttgtcttctgtactgttattttcaacgatgataaattcaatatttttatattcgcttttatttataattgattttacacatttatccaagtcatctgtatgatctttattcggaatgataatcgaaacaagtggattgcccggagtctcataaatcacatgatacattccccaaagtcctgtatgttctactttagctttcacacctatacgtttaaagtgatcttcgattgctctttttcctgcgtcataagcatacattttacttgccggatcacctgcaacagaattcatatgtattctccaatgatataatatcatcggaatatgtttaatgctgtctgcattttcaatacatctgaacatcagatcgtaatcctgtgagccatcatattctggtctaaatccaccaatttctttaataatatttgttttcacaacaaagaaatgggtaatatagttatgtgaacagaataaatccatactgaaatcaggcttaaagtttggatcattatgttctttcccatctccggtaatcttgtcttcatctgtatataagatgtcatactctttttcctgtaatgcttttaccacttcatataaagcattcggtgcaagaatatcatcatgatcaaacaatcctacatactcaccggttgccagttctaacgctgcattcgtatttcctgaaattccttcatttttttccagtaatgtatatttaattctgtcatcctgttttgcatatttttccaattcagcctctactgcagcatcaccttcgcttccgtcagcaatacataattcccaattgctatatgtctgatcaacaacagaatctatcatttctctcaggaaattaatcggtgttttgtatgtcggaacaataatactgatctttggttcgaattcgaatttaacttttttctgcttttcaagttcttcttttgttggtttatttaattcaaaccattcaccgtacggcattgcagatgcatttacacgacttacaatatattccttcagtccttttacaccatgttttctgatatggttaattcctttttctatatttttcttattgatgcattttactaattgttttgcaaagcccctgcgagcttctactttattatttctgcggataacttccggttttaattcaattcttttcctcttctttttatctgcaattgacaaataatatgttttttcttcctcatatggaaattcaattgtaaatccgcattcaatatctttttcttctacaaaaccaacttctaccagatcttttcttgacattctggtcaattttacatcatcaataatttcttttttgttctcatccaaaatgctaattttcacatagtcggttccccaatcagaaatagtccatcctccgaccaaaatttttgcattatttattcttacataatccaaattatacgctattgtactatcatcttttatcttatcaatttcttttttattaaggctacatattttgttgattttctctccactttttacaaacaattcaagtttttctaattcttcactatcttttggccaacatgcctttatattaaaaccgctctttactgggacattgcattttctcgaatatttcttttctacatctaaacgttttatacttttcatttcatattctacgttttctccattcatttttactgcaaagcttacattttgattatttacatcaaatccccatcctgttatacgtacataattttcatatggctctattctatatactttggtatcaatatggtacttataattcattttccattttctccttcatttactattaaaaaacacaaaaaatatgctacaattttcattgtagcatattcttttactgttcacaatcttattatatctctgcctattttaaatcgatttattattactttttctaataatatctaatagcagttacaatcaacatcattcctatcataaccacactaatcgtaatatctacaacatagttttctttattttttttgctatctcctattccacctaacattgacaataacaaaatcattggaatcagatatcttccttgcattccagatatttctttcgatttaaccgttgtccaacttaagtaaagtgctaaacacgaaaaagtatatattcccactcccataagcgaaataagaaatctgtccattttttttaattcaatactttcttcttgaaaacaaactttggcaaatccaacagtacctattacacctattatcggatacccataatctagccatccaaagctactcaacattcctaatgtattgctaaattgatttataaggcataacacaaatgctcgtccccatttgctcgtatgcttcaatatgtattccatttgttttgttgaattaacatgcatagctttcaaatacgcatattgctccatattcacagagaattttgtagtatacaaataatatccaccaccaactattatcacaacagccaatgctccccatttaattagcagtctttttttcttttccacattttccattggtaataataaattcaatccagcaataaaaatatttgtaatctttgctaacggaattaatatacaaagtatttcaaaaatacaatactcttttattgttattgttttcttatcatataaataaataaaatatcctatagtcaaaatgctcagtccgttaataatagcatctggactaaaagaagctgcttgctgaatcgacataggtaaacttgccataaagaaaagaacaaatttccattttggtgcaattttcactgcgcttgccacaataattccgtaacacagcaaattcatgatacgtccaaaccacaaaagccatattgcatccatatgtaaaacttttgcaagcaatattcccatagtctgtggtaaatataaaaacgacaaattcgtcgcagctacatgttttaccgttgttggagtataattaatttttttattttttaaatctgtttttgtaaatgccgtctttccaaaatgttgcaagtcattaaccgattgaatagatggaaattctttatctttttgtccgactataatatgaccctcagatatcatttccgctcttgcaaaatgagccgcttcatcaggaatattcaacaccggttgtataaacagcgataaaatacctgcaaatattaaaaacacaaaaacccatctatgaaactttatttttataaacgaaaacaatattagcaatattgttaatgttattactacgacaatacttattataatctgatttttttcatttttaggttgtttataactccaaaaaacaataaacatgagaacccaaaagctaacacttcctataatagcattaatttttacatatttattttcttccaaatatatcttttcttttaacataactctcccaataccaacaatttattttttttctatttcatccattttttcattctgctcttttttatacaaagcaatttcttgagttaaatcttttatttgtatcgacatttttgatactgatatagttaacgaaaaaattattgttaaagagaagcaaaatcccagaaaaaacaacatattcattggtgaagcaattcccataatcgctgaaattttattcataatttgtggaaaaagcgtcaaaataagtatacatattccaacacctaaccatgtcaatgaatatcttaattccaaagccttttttcttaccatattaataatatatactattccccaaattataattatagaaatgataatttgagcctttatattcattgtcattattttttctctccttttcttatactttcaattaatatcgccaaactcacctttatcatataataaattgattttcctgccgaaatagaagaaactcctccacttcgttctttcataatgacaggaatttctttaactttcttttttcttcgtaagatagcaacaatactttctggttctggataatcttttggataatcggacgcaaacatttctattatatccttattgatcatacgtaatccagaagtaggatctgttattttctttcctgtaagcagctttattaatcccgtaaaatatttgattcctaaacgtcttgctccagatgactgaaacccttctttatttataaatcgagacccaataaccatgtccaatttattttccactaaatattctgccattttttctaaaaattgcggatcatgctgaccatctccatcaacctgaactgccaaatcatatccattattcaatgcatatttatatcctgtttgaacagccccaccaatccccaaattaataggtaaatccacataattgaaatgattttcttcacaaatctttttcgtattatctttagaacaatcgttaataattacataatcaaaatcatttgttcccttttcaatcattttaatcgtacgctcaatattttcttcttcgttataagccggtataataataagttttttcataagtacccccatcctaaaatatttattttttatcatttttaaagaccaaaaatttacccaatatgtaattagccaatactgcagcaaatgctaaaattacttttgcggccaattttccatctatcattccgaatttcaagtttcccattctacaaatggataccaaaaaaaataatccaaattcttcaataatcaaaaatgtaactatcctagacataacaaacgaaatcaattcttttacccatacttttattttccagctatgactttcaaacacaaaatatttatttgttataaacgcaaataatgtagcacatataaaagaacctacatttgcaattaaataatattcacttccaaaaaatttttcgaaaatcacaaaggagccaaaatttacaatagttgtccaaacgccaaaaaaaatatatagtatagtttctttattaataatcttttcaatttttttcttcattttcatttccttcctagtcattctgatacagtataacactcttaagataatgtgtcgagttcgaatataaatattatttctaaacattacgccttttccaaagtaatattccttatttcaataaattcatttttattaatttttacaaccatctacaacatctaattctatttcttatacctatagttcttttgcgatattgcaagatatatacgacaacttaatttatgcaaagcttcttgtccaaaatacgtttgttttatcatcatctcatcttggagtttttgagagcacacaaacaacacctgcagttctgtttccaatgtcagctcacgtttctttaatataacatacagaaaaatactcctcctacaacttctattatatattttaacattaaaactccccctttcgccgaatctacagtgaaagagggctattttatcttctgtatttttatttaatttcaaatgttgtccctgcgacattatgggcatcacccttgccatctataatataaatatgaacattatattctccttgcattggttcataatttgataaatcaacttttgttttacaaatcccattctcaaagacagctaaatttacccattgtaaatcactctgatcttcatttttccatactgcagcagtaatagattgcaatccttttttcaaatgttcaatattctctacttttatcaacacttgattatctttgcctgttttttttattttaacatctgctgtcggagacactttttcttcttcttttcttctatattcttcttcatcaatatctgataatttttccatcagttttgatttttttaacattttattatattctgctgtaacaccttctttttccgataaagtttctttcgcagaaaaaagattcgttcctaaccccaaacggtcaccttctatttgtgctcccattgctgaaagcgttgttggaaaatcatcaaaaattgtatatttacgttttttttctgtctgcttttctgcatctgcatttatgtatgttgtgtatacccttctttcgtaatctttatctacatcttcacaaaaatcactatccatggtttgatgatctcccgaaataacaatcgtcgtatctgcagcaaaatcctgctgctgtacccagtcaataaattcttttacctgtctgcttgaacaagccattacattcgcatactgattatctccgaatgtatccggacaaatatcacatacatatccatcttcaaaatgtgtatccactgtcagcatcgtaagattaaaaggattatcctgctgagcgagttctaataatttttcttttgcaaatccgaataatttttcatcttcatatccccaccagactttataatcttccggaatcaggccattatcctgtgcgtaattgtaatccataatgtcatattgaccatgatctgtaaaatataattttcgtccaccaaatgttgcttctgatccaattagcagtgtctgcgaatatccttcgttttgaagaatatctcccaaagttgttattcccgggaaaaatgaatcctgtgtatccatactattcccatcaattgaaatattcaatggcaaccccgatgtctgcccaaacatcgctcccatcgtccaagtcgtccccggcatggaatagccgccgttcaatttattgctttttccagaaaaatcttcattttcctgagcaagctgtgtcagttccggaattacattttgtttgaacgcaccaccgttttctttgtccgcatacgtcatttccattgattccagaaaaatatatatcaaattacgcttctgctctggaaatgtaatattaacactcgatggatccacataattatcatcaataaatgtagaatatgtactctgccccttcatataattcgaaacatctaatccattccatgctacacctactgtaattcctgtcactgcaacagctcctgcagaacatactatagcaattttcttcaagattcctgcatgatttctatttgccgctattacaaaaagaatacatcccaaaatcaatatcgccggaactgcacattcattacaatagtctttgatcatatcggtatttgtaccctctaaaggtgctgtaagatgatataccagttcatccattgtcagatttgtccatgttttaaacatccattttgcactgaatgcaagaagcgatgctaacaacgccagtattgtgcttaaaaccagccctgcaactaagattatcttatgttttttcttcattattcttctcttttcacttaatttttcgtttttagacggaaaacattatatacaatttttacaagtgttacaaccaaaatcattaaaatttcatctttttttcacactttatacaaattactttttaaacacaaccaacctctgccccacataattgaataccacaaatgcacccattccaaccagcatagacaggttctcctgcacactcttactctgatcatgaaggatccttgacacaaccggctttgccatcccatatgccagcagataacatattgtaatatttatcacgaacatccccagttgcttccaggatctttctttattctgaaacgtaaagtatttattcaggaaatagctcacaatacttcccaccacataattcgatgcagaagatacccagtagctcagatgcaaaagattgtaagcagcaaacattacccctgtacccaccagagtattcacaattcccaccaatacaaatttccagaatgtaatatccagcatattttttattttttctttcataattacctgttcctgttcttcccttcttgttgtttcacatttctaatgttcataccagtattcaacttcttattatgaatcatatattattaaagaacaaaacacaacaaacggctcatgtcacacacaagccgcctgtcctatttccttattatttttttactctccaagcccgctttcgaccgcatccatcatcgctttcatggcctcttcttcatcttccccgtcgcagataagctcgatctcatctcccgatttcacgcatgctccaaggacactcaatacacttttcgcatttgctgcagtgtcatcgttatacatgaattctactttgcatttgtatctgcttgctatgttacagaacatccctgcaggtctgagatgtagtcccgtcggatttgttattgtaactttctgtctgatcataatgtattctccccatttctgtctgttattcgctctggccgttctgattgttttcatctgtctttgtctgactgctgttctggctttcaccctgtgttttactgctctgctttgaattttcaagtgtgatctccacattcacttcattcacaagtgtgcagccatccggcagttcgacagacaccggaacagtatatgtaccaggctctgtataattcttaagatcaatgctgactttcttcgcaggtgagaacagattcaacacatcattcggtcccttcacctgtatctccagatcaacggtagatccgtaattgatgctcagtccgtccgctatattctccaggatgatcgatcctgtcgatatctcaaagctctttgttcccggctgttgtatctggatggatattaccaccttattcgcattctcttccgcaagggacacaccgctcggaagataagatgagatatcaatggtctgctccgttctctgtgtcagttcttccaatttcagggcactcggtggaatatcgatctccgagatctcggcaagcgtactcttatcacctgtcacttccacttcctgcggttctaccgtgatcttgccaagtttatacccttctgctgccgacacctctgatgtatccactttaagcggcacgcttttcacctgaagcagttctacctcaacactgacaccttcttttccaaggttgtttgcgagaagtgtctggtcgatcacattattattggcatcatacagtaccagttttgcttctaccgtctcatcttcggataatccggatacgtttgcttctgctgttacttttgcaatattgttaatgattctcttcggtccgcgaagtgttactttttctggaagtgctttcaggcttcccacttcatatccgtttcttaccgttcctgttgttgtcggtgtgattgggaaattattcttcgcttcctcatcgatctggatctgcagatttcttggatttgccgttgccttttcatattttcctgtatatcctttgaccgttacttcaatcggcacctgtgtacgaagcgtcagttctttcatattcgctgtcgcaacaatatcctctgccctgatcttatccagtaccgaccgctgtgctgtaactgttacattaatctcctgtgtgttatccacgatctgatacgtattattattgtctgtaatcacttcttcatgcgttacctgcaccggaatattggaaaatgtcttgtcatccaccggatcatcgatattcactacaaccagccataagaatgccgcaatcaggaaggccagtattttcagcgcaagattgttagttattctttttcgcatgcttccgccatcctttccacattgcctttattctgttggtttcactgctcttatgctgtacctcttccagcttcacacgaagttctgcttcattgatacttcttgtaagctctcctccctgtgcgactgacacagctcctgtctcttctgataccgtaatgaccagtgcatcactgacttcgctcattcctactgccgcacggtgtctggtgcccagatccttgctgatccccatattatccgagaggggaagatagcaggttgccgagacgatcctgtcacctcttacgatgatcgcaccatcatgaagcggtgtattatgttcgaaaatattgatcagcacctgactcgataccagacagtccatctggattccggtgctttcatactccgtaagccgtattgcctgttctacgacgatcagagcccctgtcttgacttttcccatggcaaagcatgcacggataatatcctctcttgtctcttcactgaaacgtatctcccggttctgttcaaaaggaacaactgatgtcaggaattgcttctctccaagcttttccagtgccctccgcagttccggctgaaatactacaattgccgctgtagccatgaccgtcagtgaatttctcgcgatgaacaggatcgtatgcatcttgaatatagctgcgagaagaataaagcccgcaagtacaatgattcctctgagcagcatccatgctttcgtattctttatccatatgatgatctgatagatcagaaaagtgaggatcagaacttctatgatatctgtgatatgcactctcggaatataaagtccaattccatatttatcaataaaatccgcaattgtctgtcccattcctctcacctccctgcatggtttttaatgatttttctgtctttctatctttttctgcggttgcctgcatgaaattcattttccagactctgtgtcagaagcatcttatctacatctttcatgtcatgctttttcggtgccggtcctctcttcggcgaatgctttcttgcctgacttgcccggatctgtgccggacttctgtagtctgcatcaccatatgacggcttccgttctgcttctcttttctgtccatgtcccgcatgtacttccagatcgatggcttttgtctcttcttccgccgtatcctgcgacaaacgttttaccgcttctgcatcgatgatctccgtctcctgacgttcattgatcttcttcacagtcttctccggcgttgtcatggcaaccttcggtattgcttttacatagtaataatattcatcgtcttcaaactgcaggcgttcacttcttgcataatctaccgagaacaggaataattccagcacaagtcctgcaacggctgccgcaatatttcctatgatcagcggaccataggaggtgtttacgcccagtgcaatacttcccattgccgttacgaccacattggcaattgctcccgcaataatcccaatcttccaggcatgatccagttcctgtctgcggatggtataaatgataaaaaatccaatgataaatgcaactatgtagagccacatttctttattctggaacactttctgtacgtatgtgctgatctcggcaagcattgccttacttccagacgtcttagatgccgcacttattttcttaagatattccatcatataatatacaacagttccacatcccatcggtacaagacttaccggtgtatagatcaatgcacatgcaaccggtaccacaaacggtatcttaagtgcaaatgcaatcggtgtcagaagcacaacaaatgccatcttcggtgccagtctgatataaaatatatacatgatcaggaagatcagtgcagacactgcgaatatgcctatggacgctgccagtgtatgtgcaagcagcagtatcgttgcaagcaccaccataaccgcaggtggaaggaaagtagcaaccacagccagccccagagagatcaccggtgaggaaagtgatttcataaatcctgtattctgattgatcattgtaaatgttatcattgccagtatgaactgaaaggctttatcaaacgacttggaatgcttcccataaaccgcttctattctttcacgtattacatatatattgtccatctatcttttctccttttcatacattttcagcagttgaatcagattatgattatactttttcactcttttccttgcctttttgtgtttctcattataaatgtgactggcaattccgcaatatacgatcaccacacccacatagcctgccagaatgatcagaaaaaggaacaggatcagaccattcgacatattactcattatatcctccacaccggccagtaaaagcagcgccaccagacacacataaccgactgatacgctcagaaatgcatatataacgtgcaggcttgcataatcttttctataataggaactgatcttaaaatcttcttttccataagtctcttcatagagagcaagctttgtcattaattttacttttctctcatctaacatatatccacctcaacatgatattaattccacaaaaacatcattttaagtataacaaatatcagtacccttgtccaatacttatagttaaaaaataaaccttctccacgccttttccctttaatgcttttgccgccgcatccagtgtattgccggtcgtatatatgtcatccaccagcagcaccttccggacagggcgaaatgccggtgttaccgcaaatgcatttttcaggttcttttttctctcattatgtccaagtttcttctgcggactggtcttctttcttcttgccaggcttttactgtccaccggaatgcacagcatccttcccaggttttccgcaagaatctgtgcctgattataaccccgttttctacgtctcgcccggtgcagcgggaccggtatgatcacatccgggttccatcgccggatttctttctgaaaatttttcacaagttcctgactgtacagttccccgtatcttctctgattgtggtatttgaactgatagatagattgattcacaggagctttatggttccataagcttaatccctgctcataataatgatgtgtatgcatacagtcataacagtattccttttccatactacgaatctgttttccgcattgcatacaccttggttctctgattcttaagaattccagcctttccctgcattctgtacagatgccctctttacagactttctgacagaatggacaggtttccggccagaacagaacaattatattttctttgatatcttgtatgatacttttattcattaaattcacggattcgctctgcgagactcgtattgcggttctgctggtttgtgttttgtatcatctcctggaatacgctttcacttccgatcaccgtcacacattttctcgctcttgtgacagccgtatagagcagatttctataataaagctgtcttggtccctgtaacaaagggataatgactgccggatattcgcttccctgcgctttatggattgtgatcgcataagccagttccagttcatccagcagattgtatggatattttacctgcttcttttcatcatattcaaccgtcacggtctcttcatatgtattaatctttttgatgatccccatatccccgttaaatacaccgatccctttatcgatcgtcattccgtaccgggtggtgatctcccactcaagctggtaattattcttgatctgcatcaccttatccccctcacggaacagatgatctccatattctttttcctgtttgcccggcttcggtggattcagatattcctgcaggatcttattgatccgttccactccgagcaggccttttcgcatcggcgtcagaacctgaatgtctgcttctgatgcagatacgaatttgggaagtttcttctggatcagtgtgatgatattactgatgatcatattcgtatcatcacgtttcaggaagaagaaatccatgcttttgttatccagcacaaccggttcaccccgattgatcttgtgggcattgacgataatatcactttcgcctgcctgccggaatatcttcgtaagctttaccaccggaaaacatccggatgaaataatgtctttcagtacgcttcccggccctacactcggaagctggttcacatctcccaccaggatcacacgggttcccggcacgatcgcattcaaaagtgcatacatcaacggcagatctaccattgacatctcgtctatgatgatcacatctgcttccagcggattctctgcattgcgctggaaaccaccaactgtctcatcatccggattgccggatacttccagcagccggtgaatcgtctgtgcttcacatccggttgcttcggtcatacgctttgctgctcttcctgtcggtgctgccagatagatgtccagtccttcactttcgaagaaatgaatcatcgcattgatggtcgttgtcttaccggtacccggtcctccggtcaatatcatcagaccatgcctgactgcttccattactgcatctttctgcatctcatccagatacagttctgtattcttttcaatctgattgatcctgtgaagaagtgtcacatcagctgcttcaaaatcaagattcagatcatgcagcatcttcgcagtattcaactccatataataataatgggaagtatacactctcaccccctgctctgactgcttcatgacgatcttcttttccatcataagatccataagatacttttccatatcttgtatctgtactccaagaaggtctcccgtctctttcagcaacacgtcctgatacagatagacgtgtccttcattcacactctgttgtaaggtataaaagattccgctgcggatccggaaatcagaatctgtatgtatgccaatcttcattgcaatctcatcggcagtcttaaatcccactcccggcacatggtctgccagatgatacggattctcctctatcgtgcggtagacattacgtccgtaatgctgatagatctttgctgccagtgttgtagaaataccgaatttctgcagatagatcattgcctgccgcatatccttcttctcttctacctgtgaagcgatctctcttgctttccgttcactgattcctttgatctctgccagtcgttccggctcctcttcgatgatccggaaggtatcttctttgaattttttcactatctttcccgccagagaagctccgactcctttgatcgcaccggaacccagataccgttcgatggataccagatcttccggctcacatatctccgattcctccacagcgaactgaaggccatacatcttatgcgttgtataacctcctttcagtcttaacagttcaccttcttcaatataatgaaaacttccgacacaggtcacttctccatctgaattattcagatggaataccgtgtacccgttgtcttcattgcggtaaacaatatgttctacgtatccttttatttcttccattcgatttcactcacccggattcctatctgaatctagattccttttctgtcacccataaactctacgtattctccggttccgatggcaacaaccttcatcggatcatccgccgtcatcgtgttgatgcctgtcttttcctcgatcagttcttccataccacgtaacatagatccgcctccggtcagcataatccctctgtcaaggatatctgcggaaagctccggtggtgttctctccagcacgctgataacagcttctacgatctgtcccgttgtctcccggagtgcttcttctgtctctgtcgaagttaccgttaccgtcttcggaagtcctgttaccaggtttcttcctctgacttccagcgtctcatcttcgatcattggataggttgtaccgattttgattttaatatcttccgctgttctttcaccgatcagaagattatgtttttttcgcatatagcggacgatcgcctcgtcgaaatcatctccggcaatctttaaggatgtatttacaaccgttccgccaagtgagatgacggcaatatcggatgtacctccgccgatgtcaacgatcatattgccacacggctttgagatatcgattcccgcaccgattgctgccgcaaccggttcttcgatcagatgtacctctcttgctcctgctgcataagttgcttcctccactgccttgcgttccacttctgtaaccccgcttggtacacagatactgattctcggcttcttgaatgtacgctttccaagtgttttctgcacgaaatatttgatcattttttctgttactgtatagtctgatatcacgccctgtctcaaaggtctgactgccacaatatttcccggagttcttccaagcatcagtcttgcttcttctccgatcgccttgattgcattcgtatctctgtcatacgctacaacagaaggctcttttaaaataacaccctttccttttacatacaccagtacgctggcggttcccaaatcaattccaagatctactgacattcccaattctcccttcatcaagctgtctatattcctatctttggtgagatatgattatatcacatgctatttttgagcatgttcccattataatcaaaatcatttaaaataaaaagacccattttgcttaaatctttatgaacctttttacataaatattacaatatgacgaatccggacgatgtattgaacaaaatgtcatatttctaccgttccagcattggttttatatactttccggtataggataccggacttttcgcaacttcttccggtgttccctctgcaatcacggttccgcctttgtcaccgccttccggaccgatatcgatgatgtaatctgcggtctttatcacatccagattgtgctcgatcacaatgactgtattcccatcttctgtcaatctgtggagaatctctgtcaacttatgcacatcggcaaaatgcagtcccgtcgtcggctcgtccagaatatagattgtctttcccgtacttctcttactcagctctgttgccagcttgatacgctgggcttctccgccagacagagtcgtagacggctgtcccagacggatataagaaagcccgacatcatacaaggtctccatctttctgcggatacttggtacattttcaaagaaatgcattgcttcttctacggtcatgtccagaacatcatagatattctttcctttgtatttcacttccagtgtctctctgttgtaacgtcttcccttacatacttcacatggaacatagacatccggcaggaaatgcatctcgatcttgatgattccatctccgctgcaggcctcacatcgtcctcctttgacgttaaaactgaatcttccttttttatagcctcttgcttttgcatccggtgttgctgcaaacagatccctgatcaggtcaaatactccggtataggttgccggattggatctcggagtccgcccgatcggagactggtcgatattgatcaccttgtccagctgttccagtccctcgatgcctttgtgtctgcccggaatggtccttgcacggttcaggtctcttgccagacgtttatagaggatctggttcacaagtgagctttttcccgaaccggacacaccggtaacacaggtcatcacgccaagcggaaacttcacatctatgttcttcaagttattttcctgtgctccgagtactttcagccatccggttggttttcttcttacttccggaaccgggatccggatacgcccgctcagataggctccggttacagaattttcattctgcatgatctcttccgcatttccggttgcaactacttcaccgccatgttctcccgctcccggtccgatatccacgataaagtccgcttctctcatagtatcctcatcatgctcgaccacgattactgagttcccgagatcccgcagatgttttaaagttccaagcaatttatcattgtctctctgatgcagtccgatacttggttcatccagaatatatgccacacctacgagtccggaaccgatctgtgttgccagacggattctctgtgcctctcctcccgaaagtgttccggtcgatcttccaagtgtcagataattaagtccgacatccatcagaaactggattctggaattgatctcctttaaaatctgtccgccgatcagcaattgctggttcgaaagtttcagttcttttaaaaaggtctgcagtttttcaattgacattcctgtcagttcggaaatatttttatctcctaccgtcacagcaagtgctcccggcttcaggcgctggcctttgcacgcagaacacggtgtgatattcataaactcttcgtattctgctttcatcgtttccgacgaagtctcccggtaacggcgctctacattgcggatcagaccttcgaatgccacatcatagactccttctccgcgctgccccttataatatactttcacttctttgccgtttgtcccatggatcaggacatcatggacttccttcggatagtcctcaaacggtgtatctaatgaaaagccatattctttgctcaacgcatccaggatcgcatacgtgaagctcttcttatccgtgcaggactgccatcccataacagtgatcgcaccttcactgatactgagacgtttatccggaatcatcaggtcttcgtcaaattccatcttgtatcccagtccaaagcactccggacatgcgccgaacggattgttgaacgaaaagcttctcggttcgatctcttcaatactgattccgcagtccggacatgagaagctttcgctgaactggaccggttccccgccgatcacatccacggtcatcagtccttccgcaagattcagtacattttcaatggaatcggtcagacgctgttcaataccctcttttactaccagacggtctacaacaatctctatattgtgcttgatgttcttatccagcttgatctcttccgacagttcgtacatattaccatcgatcctgactcggacatatccgctctttctggcacgctccaataattttacatgggttccctttctgcctcttacgaccggtgccagcagctgtatcttggttctttccggaaatgccatcacctgttctaccatctgatcaaccgtctgtttcttaatctcgcgcccacatttcggacaatgcggaattcctgctcttgcatataataaccggaaataatcatagatttccgttaccgttcctacggtagatcttggattgcggttcgtagatttctgatcaatggaaatagccggagacaatccttctatactttctacatccggtttttccatctgtcccaggaactgtctggcataagaagacaatgattccatatatcttctctgtccttccgcataaattgtatcaaatgccagtgatgattttcctgatccgctaagaccggtcagtaccaccagtttgtctcttggtatgtctacgtctacattcttcagattgtgttcatttgctcctctgatcttgatatattgtcttgaatctttttcctgtggcatgtaagtctatgatctcctttttctatatctttatttcctgtaatgtcttcttaagctctattaacttatccctgagttctgctgccgcctcaaaattcagatctgccgcagctttcttcatctgcttctccagctctttgatcagcttctctaattctttctcactcatggattccggatctttttccatctgtaattcagaagccgccactttccgggatactgagatcaaatctctgactgctttctggatcgtcttcggtgtaataccatgttcttcattatatgccatctgcacttcacgtcttctctgcgtctcatccagtgctgcacgcatggaatctgtgatcgtatctgcgtacatgataacatgcccttctgcattacgggccgcacggccgatcgtctggatcagagacgtctcggaacgcaaaaatccttctttatccgcgtccaggatcgcaaccaatgtgatctccggaatatccagtccttcccgcagaagattaatgccgaccagaacatcgaatacgtccaggcgcatatctctcacgatctctgtacgttccagcgtgtcaatatccgaatgcagatagcgcacgcggattcccagctcacgcatatagtcggtaagatcttctgccatacgtttagtcagcgttgttatcagtattttgtgtttattggcaatctctttattcacttctccgatcaggtcatcgatctgtccttctaccggccgcacttctacttccggatccagaagtccggtcggccggatcacctgctcggctcttaaaagttcatgttcttcttcatatttccccggtgttgcagacacgaacatgacctgatcgatcttattttcaaattcctcaaaactaagcggacggttgtccagtgccgatggcagacggaatccatactctaccagtgtacgctttctcgactgatcgccgtgatacataccgccaatctgcggaaccgtcttgtgcgactcatcgatcattatgataaaatcatccgggaaataatccatcaatgtattcggcggctgccccggagcaagtcctgccagatgcctggagtaattctcgatccctgaacaaaatccggtctcgcgcatcatttctatatcaaaattcgttcgttccgcaattctctgtgcttccagaagcttcccttcttctttgaaatatttcacctgttcttccagttcaatctcaatattttttattgctttctccatacgctcctttggtacaacgtaatgggaagccgggaatatcgcaatatgattcaatgtatttttaatctctccggtaagcatgtctatctctgaaatccggtcaatctcatctccgaaaaattccacccgtatagccgtatcgccccggtctgccggtacaacttctacagtatcgcctcgtacccggaatgttccccgcttgaaatccatatcatttctgtcatattgaatatctatcagctgacgtaaaacttcatctctgtccttctccatccccggtcggagcgataccatcatctgttcaaagttctccggttcaccaagaccatagatgcaggaaacgctggcaattacgatcacatccctgcgctcgatcaatgctgccgttgccgataacctcagcttatcaatctcttcatttacggaggaatccttcgcaatgtaggtgtctgaagatggaacataagcctccggctggtagtaatcgtagtaggagacaaaatattctaccgcattattcgggaaaaactctttaaattctccatatagctgcgcagccagagtcttattatgcgcaatgacaagcgtcggtttattgatctgctgaataacattcgccatcgtaaatgtcttaccagatccggtgacaccaagcagtgtctggcactgatttccttctttaaagcctttgaccagatcctcgattgcctgcggctggtcaccggtcggcttgtattgtgatactaattcaaaatgatccatatgatttctcctaagccgctctgtctggcggtgatattttagaaatagtagttgtatttttagtattgttacttgtatagtatatcattcaggagaaaaaaagtacagaactaaaccgaatgtttgttctgtgcttttttattactttattttattatcaaaaatgccgaacacttttacgcatttcatgatatacttaaatcagtttttacacggatacaaggagaagcagattatgaaaaaactcagaatcttatggggaattttaaaacgtacacgggcagatcatattcttttaggttttgtcctcttcctcctggccgatgccgccgttatccggcttgtcgaaccggatatccaccgctatggtgatgcgctgtggtattgttacgccgtcatctctaccgccggatttggagacattgttaccgtcacactgattggaaagatctgttccgtcctgctcacgatttacactatttttgtcgttgcgatcgtcacaggtgttgtcgtaaacttctacacacaactggttgaaatgcagcaaaaagaaacacttgctatgttcatggataagctggaacggctcccggagctttcaaaagaggaactggaacatatctcgcagaaagtccgcaaattccgttaaaaaatacccgctgtcaatatgtattcctgtttgcatcatcgaaatacatactgataacgggtattttcactatacttcttttcccatcttcttcacacatttacttcccactgctgctgcaataaatatccatataaatgttttcaccggaaaacacaggaacaaaagcatggtcaccgccagcggcttcttcatgataccgcccagaagtgtcgatgttacaatcgccgccgcaaatacaacatgactgtccccctgctgtccgaagaacagcatcgcaagtccgtatcccagacatactcccgcaaaaataaccgggaaaaaatgtcctccttttaatccaaactggatacagagatttgtcaatatgattttcagaaatgctataccgatcaatgctatcgccatataaccggcatactctttcataagaacacccatctgctcttctcccgaaaacatcactgccggtatcaacattccgatcacacccagacataaccccgccagaatttcttttacgacacccggaatttttccggcaatgattccggttaccgtatgtgtcgtctcataaaaatatgcaagtacacatccacagaacatatacacaagcatcatcacataatcgattctctgtacctcaactgcatcaaatgacggaaaaccggacattcctccacccagcaaagcggaaagtcccgcataacttcctgttccggctgcaagtgcaattccatatatgaagatcttggatccttttccaagctctgccatctgcatatccggatcttcttccacctcaaagattccaaataacggtgcatgaaataacacactaagggaaacggctgcaccgatctgtgaatattcctttgtatgctgttttgcaaatttcagattttctcctgcccagtaacataagcctacgataatcccggtaagtcctgcctccggacccacactgcttccgatcagaagcggcagcagtgctgcgatcatcatgaccagcatatttttatattcgtatcttttttctttttttacttttcccataacggtttccatatcttccggataatccccgtataactttcgaaatatcccgataatggctccgcccacagtacacacgagcactgtataatacggaatatggattctttccggtatccactcccatatcatttctgttcctgatgccatgatcttcagcaatgcccagaccaaagctcccgccacagttccaatgaccgcacagaatgcccataattccaattggttttttattttgatcttctgtatattcttttccataatccactcttatccggttctttttatcgcttctgctccttctcatctcttacctgcgggatcagtgatgccgcaagctttcctttgccgcggtgcttcagatatagaattccgatgatcgagaacaccaccgctccgataaaattcaccatcagatctttcatcgtatccactattccgatatccagatatccacccagattccatttttcgccattgatcaccactgactggatgtccacatgcaccggaacatttgcacctgtcgggttgagtttcacagagttgatcgatggaagaatccagtctttctgcatatccagtccgaagaaccagtccatagaaaattcgaagaactcccacaatacaccgactgtcattgaaaaacaaaatgcaaaaaatgccacgaaatacggagacatcttaattgagaaccggtcacttctgttaaacaggtcaatcagtgcaaatccaattgccgccataagaaaaccgtttgtcgtatgtaaaatggtatcccacacaggaatctttacataaaatgcgttgatctctcccagtatttctgccgaaaagataaagatcagaatcaccgtctccagtcctaccggaatcgttacccccagtgtctgatctaatacagcaggtaccatgaacaaaaacagagtcaaaattcccagaaacatattgtggtaatttcccaggaaaaactgtctgactaccgacagtataacgaaaaccgtcaacaccatctgaatttttgtcctttcctttttcaaattcactccttttagattcataacttttctccatctcttttcttaatttttttccgtatttctacgtttactgatatcatatcatattttttgctgtcaagcctaaaaaagtccttaaacaagaatttatacatccggcaacagccggcatcacgattcctgcctaaggacttttttattttttaattatcttaaggtttcccctgcaaattcattttattcaaatgactgttctgtacggttgatgatctcatcctgtaacggtttgcttaagttacggaagaagtcactgtatccggcaacacggacgatcagatctctgtaatcatccggatgtttctgtgcttcgatcagtgtctgtctgtcgatgacgttgaactgaatgtgatgtccgtccattgcaaagtagctgcggatcaggctggacatattctcaagacctttttctccggctacaacatccggtgtaaacttctggttcagaagtgttcctgctgttgcaaggtgatccatcttagagcatgacttgataacagctgtaggtccgtttgtatcagcagacttctctggagagataccttccgatacaggtacattcgcttttcttccgtttgcagttgctccgatcacttctccgaagtatacgtgacatgtagtaggaagcatatctactccgtattttccgcctctcatggtcggacgtcctgtgatcaggtcatgatacaggttgaatacatcctgcataacagaatctgcataatcatcatcgttaccatacttcggtgtcttgtcatgtaccatacggaagattgcatcataaccttcgaagttatgatccatagcttcaagcagctcttccattgtgaaattcttcttatcgaatacattatacttaacagatgtgatacagtcggtaactgttccgatacctacaccctggatatagtttgtattgtatcttgctccacctgcattgtaatcttttgcattgctgatgcagtcatttgttaccactgacagacaaggtgccggcatattctctgcatataatttctcgatcacattgtttccgcgaatcttaatatcaataaaatgtttcagctgtttctggaatgcatcccataattcatcataagacttgaaatcttttgcttcaccggtcttaaggccgagctgttttccggattccttgtcaaatccattataaagtgtcagctggaatacttttggaatattcaggtatccggtcaggatatatgcttcgcttccccatgctccggtctcaacacatcctgaagatccgccacggcgtgcatcttccagtgattttcctgcattgataagctccatagtctgtgcttccgtgttatagaacgcaggctgtccccatccctttcttgagatctcgcatgctctcttcaagaaacgtgcaggagtcttcttactgatcgttacgttagagtttggctgaaccagcttcatctcgtccatacagtcaaggatcaggtagctgactgcattgacaccatcacgtccgtccggtgtaactcctccggtattgatatttgcaaagtctgtgtatgtggcactttcttttaatgtgatacctactttaaccggtgcaggctgattgtagaatttcacccataagcactctaacagttcttttgctctctcatcatccagaattcctgcttctgtatctgcttcataatatttaatcagatgctggtcaagacgtcccgggctgaatgcatcccatgggttcagttctgttgtaactgccagatgtgtgaaccagtataactggattgcctgccagtatgtctgtggtgcatgtgcaggtacaacctccaggttggctgcaatctgttttaattcttctttacgtaccggatcagcctctttttctgccagctccagtgctaattcatgatatctctcaccaagaataatcactgcatcgcaggaaatatccatggcttttaactcttccattttatccagagcatccggatcattcataaaatcaagagcatccattgtctttttgatcttctctttgtagtccagatatcctgttgtaaatacctgttctccaccacatgtatgtcccggtcctctctgctccataaactctgtgaacatacctgctgcgtaacagtcgttccattccggagtcatggaagccagaagtctctctctcatagttcttcccttccagaacggaatgatctcttctgcctggagttttctgtcttcttctgttgtgtggaaagataccagatcacgctcactcataactgtcatatcctcaacgctgtgacagcaaagttccgggaatgtcggagatgcctgtggatcttttcccttctctcctacgatcagctcaccgtctccaaggtaaagtgtcttctttgaaaaatactcttttaacaccatagctctcataaccgggatagaatattttccgtcattttctctgtaaaaatctgtttcgatctttgctctttccagatcgatgtgtaccggtgttgtaacactcagttctcttaacttctggattctttcgttcatgcctcttttttcagccattgttttaacctcctatctttgtgttagaaaaacctgcttcctggaagagtttcacaaacccctccatctcttcttttgtcggtgcattcaagtcattacctttatattccatatccagcttcggatatttactgcttcccgtattatgatatggcagcaaattaacctgtgccgggtgaataccgtgttctttcaggaaacgaatcgtctctttcatattctcttcgtttccatttacttccttaacagtagggatgcggatgtatatccttgctcctgcatctgaaagttttacaagattatctaagatcagtttattgtctactccgatatattgcttatgtaattccggatccattacctttacatcatataaaaatgtatcgacatatggaaggattgcttcgaacttctcatacggaacatatccgcatgtatcaattgtaagcgatacttcttctttcttcaaggcttttgcgatcgcaagtacataatctgtagacatagccatcacttcaccaccggaaagtgtaactccaccgccggactgttcatagaacatcagatctttcatcagttcctttacaagtgtttttaccggatattcctggccaacgatctcccggattccctgtgtacagaaattctcacattttccgcagagcttacaaagttttttatccagcttcggtcttccgtcttccatggtgaccgcgccgttcggacagacttttgcgcatacgccgcaaccggtacatttctccgcatcatactgaatttcctgctcgaagcgctgtgtctcaggattatggcaccacacacactttaacggacatcccttaaaaaatacagtcgtacggattccgtccccgtcatgaatagaatacttctggatattggttatcagatccatgatattctcctttcctcttattatacttgttattttctcattttttacccgttttagaccaacgtttgtactttagtctaatcataacaaaaaagataaagtttgtcaatcctttgacaaactttatctcattaattactatctgaaatggattctgtctattcttcattctcctgagtattcagataatttctttccaccagctcccatatctcatcacgtccctgtttcgtcactgatgagaacgggatgacgattgttcccggtaacactcccagaccttcttttacaatcttgatctgtttgtctttctggctgcgtttgatcttatcgagttttgttgcaatgatcaccggatggaatccctgtgacacgatccactcatacatcatcttgtcgttaccggatggtttatgacggatatcgatcagaaggaatactactttcaactgcttcgacccgtgcagataacgttcgatcagctgtccccatttgatcttctcctgttcggataccttcgcatatccgtaacccggcaggtcgaccagatataatgcctcattaatattatagaagttgatcgtctgtgtctttcccggtgttgcagatattcttgcgtatgatttgcggttcataagcgcattgatcagggatgactttcctacgttggattttcctgcaaatgcaatctccggaagtgtattctccggaagtttgctggtgattccacatacggtttccagattaatatttctgattatcatatatttctcctttgatccatctcctgacccgtgccagaagatctgactatacaagtgcttctttcagcacctcattcatgtgtgttacaaatttaatttccagtccctttgtaatctctgttgaaatttcctcaacatctctttcattttttgccgggacaagtacggtcttcattcctgcattttttgcagccagaagcttttctttcagccctccgatcgggagtacacgtccgcgcagtgtaatctctcctgtcatagcgaggtctgcccgtacttttcttcctgtcaccgcagacatgattgcagttgccattgtaataccggcagatggtccgtcttttggaacggctccctccggaatatggatatgtatatcatgtttcttaaagaaatcatctgtaatatcgtgctctttgcttacggaacggatataactgataccggttctcgcggactctttcatgacatcgccaagctgtccggtcagcaggatttctccttctcccggcatcatattcacttcgatctggagtgtatcaccgccgacactggtccatgcgagtccacgcacaataccaacttcatcttcttcatttgccatctgataactgtaaagttccttccccagatagtgttccatattccgctctgtcacatgaatggatttcttctttttctcaaggatctccattgctgatttacggcagatatcaccgatcttacgttccaactgtcttacccctgcttcttttgtgtaatttcttgccatcttccagatcgcatttttactgatggtcagctgatctgctttcagtccatgcttttcgatctgctttggaatcagatgttcctgcgcaatatgcagtttttcattttctgtataactggtaacctcaatgacttccatacggtcaagaagcggccttggaatggtctgcaggctgtttgccgttgtgataaataacacttccgacagatccatcggcacttccagataatggtctacgaacttattattctgttcgccatccagaacttccagaagtgctgagaatgtatctcctttatagtcattgctgactttatctatctcatccagcagcatcagtggattcttgactcctgcctgtttcattccatttgcgattcttcccggcattgctcctacataagtctttctgtgcccccggatttccgcttcgtcacggacacctccaagcgaaattctcacatacggcttcttcaacgccctggaaagagatttcgcaatcgaagttttaccggttcccggaggacccacaagacagatgatcggtgcttcgccttttttcgtaagcgcccgtactgcaagatattcaagtactcgttcttttactttctccagaccgtaatgatcttcatccagtacctgtcttgcaaatgcaatatctttatgttctttgcaagttttatcccatggcatttcaagcattgtttcgatataggtccggataacgcctgtttccgccggggaattcatggaattgcggaatcttttgatttctttgttcagcttttcttttacttctttcgaagctttcaatgcatctgccgcctgctggaattcatccgcatccgacatggtattgtcatcaccaagttcctcacggattactttcagttcttcccgtaggatgtattccctctggttcttgtccacacgttctttcaccttactttggatctcttcttttactttctgtgcctggatctcattcacgatcttatatatcagaagttcataccgtctcataacgttcgtctcttccagcagttcctgcgcatcttcgaatgaaaacggcatatttgcagcaatcacatctgtcaggtatttcagatcatgaatggattccacctgcatgccaagttcttttgaaagctttggattctttaacagatattctttgaagacatcctgtaatccacggatcattgcttctcggttcattggatcgtcttcttcccgctctccggataccacttcatcatccggcagttctactaccgttgcctggagatatggtgtctcactatccattcttacaagacttgctcttacttctccggatacaagtacacggctcattttttttggtaattttactacctgccttatggtaacaacacagccaaccagatagacatcttctgctcccggctcttctatttccagatccttctgagcgctgacgaataacttctggccgttttttaccgcctcttcaatcgcctgcagtgatttttccctgcttacatcaaaatgtctgacctcttccggcagtatcgtaagtcctcttaaggcaaccataggcagactataagtttctcctgtcatatattcacactcctgttcaccgactggattatcttggtataaaatcagcgggtacaattattcttcgcacccgccgtctttcttttcatttattatgcactttctgagtcaggttctgcatgttcacatacaggctctcctgttccttttacaacatcttctgtgatgtggcatgattttaatgtctcatccgatggtgctttatacatgatatccatcatgatactttccataatcgctctcagtcctcttgctcccgtctttctcttcagggaagtctctgcgattgcttccagtgctttatcatcaaatgtaagctctacatcgtccagttccaacagcttctgatactgtttagtcaatgcattcttcggctctgtaagaatcttcattaatgcatctttatccagcatttccaatgctactgttaccggtacacggcctacgatttccgggatcagaccaaatttcacaagatcctgcggcagaatctgctgaagcagtctgtccacatcatcttcatgcttttctgcaatctctgcattgaatccgattgatttctgatcgatacgtttttcaacgattttttcgattccttcaaaggctcctccgcagatgaataaaatattcgtggtatcgatctggatcatctcctgatgcggatgctttcttcctccctgtggaggtacattggcaactgttccttcaataatcttcagaagcgcctgctgtacaccctcacccgatacatctctggtaatcgatggattctctgattttcttgtaatcttatcaatctcatcaatatatataattccatactctgcacgttcaatatctccgtctgccgcctgaatgatcttcagaagaatgttttctacatcttcaccgacatatccggcctctgtcaatgctgttgcatcagcaatcgcaaacggtactcccagaatctttgccagtgtctgagccaaaagcgtcttaccacatcctgtcggtccgagcatgagaatattacttttaccaaggtctactcccatatttcttcccgccattacacgtttataatgattataaacagctaccgataatacttttttcgcttcttcctgaccaatgacatattcatccagaaatgctttgatctcttccggttttaaaagattgatatccgagaacggattccattctcttccgttctcgtattcaaattcttcttctataatctctgcgcagacatccacacactcatcacagatatatgccccattcggacctgcgatcagctttctcacctgattctgcgtcttgttacagaacgagcatcttacctgatcatcgttctttcctgccatacttttcacctcgtctgaggactgccctagcggttcttgatgacttcgtcaatcagaccatacgctttggcttcttccgcagtcataaagttatctctttctgtatctgcgttgatgacctctaacggctgtcctgtattttctgccagaatctgattcagtttctgacgagtttttaagatatgatctgctgcgatctgaatctctgttgcctgtccctgagctccgccaagcggctgatggatcatgatctcagagtttggaagcgcaagtctcttgccctttgttcctcctgtaagaaggaatgaacccatacttgcagccataccaatacagattgtctcaatatcgcatttgatatactgcatggtatcataaattgccattccggctgttacagagcctcccggactgttgatgtacagatggatatctttctccggatcttctgcttcaagaaacagaagctgtgcaacgatcacacttgcagatacatctgttacttcttctcccagaaatataattctgtcttttaataatcttgaatagatgtcgtaagaacgttctccacggcttgtctgttcaatgacataaggtactaaactcatgtatatgcctcctgactatactatgttatgatctgacgttatttttctactgcattctcaacaaggaatgtaacagcttcctgaactgccagatcttccttcatctgtttcttctcgttctcacccatgaattctttcagtttctcaacttccatgttgtaagattcagccatcttggcaagttcttcatcgatcttctcatctgtgatttcgatattttcagcttttgctaccgcctcaagtacaagacgtgtctcaattctcttgattgcctgtggtctcatatcttccatcatcttctctgcagtcagtcctgtgaactggaagtactgctcaagagtgattccctgagactggattctctgtgcaaaatcctctaccatctgagttgtctgtgtctcgatcattggctgtgggatctcgtattctgcattcttaacagcctgctctacagcctgatcttcctgatttctctttccgtctgctgctttctgctctttgatctttgcttttacatctgctttgtattcttctaatgtatcgaattcagatacttctgctgcgaattcatcatcaatttccggcagttcttttgctttgatctcatgaactgtgcatttgaatacagcttcttttccttttaattcttctgcatgataatcttccgggaaagtaacttttacttcaacttctttctcagcttcagcgcctactaactgctcttcaaatccaggaatgaacgatcctgatccgatagtcagtggatagttctctccctttccgccttcaaatgcttcaccatcaacaaatccttcaaagtcgagaattacttcatcaccgtctgctaccgcacggtctgtaactacaacttctcttgcatttttctctgcttcttcctggatcttagcgtctacttctttctgagttacgcgtgtagatactttatctacttccagtcctttatactcaccgagttttacttccggctttgttgcaacatctgctgtaaagatgaatgattttcctttttcaatctgaacaacattgatctccggtcttgaaacaatctcaagttcacactcttcatatgcttcagaatatgccttagggatcagtgcatttgctgcatcatcgtagaagatctccggtccatacattttctcgatcatctgacgtggtacttttcctttacggaatcccggcatagcgatcttgttcttctgcttcatatatgcactctgaagcgctttttctaaatcatcggccggaacttcgatagtaagtttcgccatgttgttttctaacttttctacctgtaaactcatttactatttcctcctgtttctaacccgcctcatgggtagcggaaaaaaagcgggtatactacaatacattcaccacagaagtataacacaaactctggtaaatatctagtccccgtttttgcttaaatccggtgtttttccgcttttttcttctatttttattaaattttatgaaaaactattaaaagactatggaatctgcgatttccttcgctttttcttcgccatccagaatctcgatcaatttcagtccaaaatcaattgcagtgccaacgccctggctagtgataatattctcgtctactacaaccgctgtctctgtcagcacgacatcttccatctcatcttccacgcccggataacaggttgccctcctgccttccagtacccccaggctctttaatatggtaggtgccgcacagatcgctcccacatatcttccttcttttgcatactgttttaccacatatctgactccgtcatggtttttcaggttcagggttcccggcattccgcctggaagcacaaccatatcaaattcatcaaaatctacttcatcaaataaatcttctgtctgcacattgattccatgtgctccatgtacgatgtaatcatccatgatggatattgtatctacatatatctttgctcttcttaacagatcaacaacagtcagaccttcgatctcttcaaatccgtctgccaataatacgcatacttttttcatcttcattatcctcctcatctcttatttattctaaattctatcaccgtttactttttctgtaaactgttgtatcataatttcaccgcaaatgaaaggagaccttataatatggaaatagaacgaaaatatcttgttgcaaagctgccggatcagctggaaacttacccatgccgccttctcgagcaggggtatctgaacaccaatcccgttgtacgtatccgtcgtgataatgaaaagtacgaactcacttacaagtctgccggactgatgtcccgtcaggaatataaccttcctcttgaccgggaatcctatcatcatcttcttggcaagatcgatggacgtctgattaaaaagaaacggtatgtaatcccgctttcttccggcctcaccgcagagcttgatatcttcgaaggcgatcttgctcctcttatgcttgtagaagtagaattccaaaccgaagacgatgcagattctttcaccgctcccggctggttcggcgaagatgtcactttttccggaaaatatcataacagctatctgagccgtttataaattgatatttgtccgcgtgccacatttcgttgctttttctcgttttgtcacgtcttgttgcatatcatatctattttatggtcagattgttatactaacagcaatatgtaacttgtggaggtttaacatggcaaatctgcaactggccaaaaacttattctatctcagaaccatatctggtctaaagcaggatgatattgctgatatcttcaatatcagccgtcaggcctgcagcaattatgaaaccaatacacgtatgccggatcttggttatctggcttcttttgctgcacattttcacgttactatggatcagcttatcctctgtgatctcgaagccgaacattttattcccagatcagaatatccttccggcatgcgcgagacggttactccttatatgcagggaatcgaaaaaaataccggtaactacatctatctcaccgaagaagaagtggatcttgtattcgcattccgttcttcttccgatgagaagcgtaaactcgctaccggttttcttcactcagataaataattgtctttccttttttcccgactttttctcaggctcccagtccaaatccatcatgaactgcattcattgctttttcaatatcttcttccggaatcagtaccgtaatacggatctcggatgtggagatcatattgatattgactctggaattgtataatgattcaaacatcttcgcagctactcccggattactcatcattccggctccaacgatggaaagctttgcaaccttttcattccatgtaatatcctggatcgtaagtctttctttattcgcattcagtacttcgatcgcatgttgcagatcctcagatgcaaccgtaaaggaaatgtcttttgttccttctcttccgacagactgaagaatgatatctacgttaatattatttgcagccagtgtattaaatacagcaaatgccgtccccggtttatcctctaatccgataacagagattctgactgtatctttatctgcagccacacctgtaaccagtaatttttccatatttgaaccctccttgactacggtaccttctgaacggttcaggctggaccgcaccactaattccacattatatttttttgccatttccacagaacggttgtgaagaacttttgcgccgaggcttgcaagttccagcatctcatcgtaagtaaccgcatccagtttttttgcagtttttacaactctcgggtctgcggtgaacacaccgtctacgtctgtgtagatttcgcatttatcagcatgaagtaccgccgccagtgcaacggctgttgtatcggaaccgcctcttccgagtgttgtgatatcgtcatatttattgactccctggaatccggttacgatcacgatctttctggaatccagttcatgcatgatgcgttcggtatctactcttttaaatctggcattcccgtaacgggatgtggagtgcatcataacctgaaaagcattcagggatacagcaggtacatccagtgcctgcattgccatagccatcaaggataccgacatctgttctcctgtagtaagcagcatatccagttctcttttttttgcgtccggattgatcgtattcgccagtgcgatcagttcatctgtagtatctcccattgcagaaagtacaaccaccacgtcatgtccggccctgtaatcttcaatgcagcgttttgccacattaaatatcctgtctttattggcaacagaactgccgccaaatttcttaactattaacatgtttcctcctgtgacagaccaatctgattaatcctggatacggatcatatgtacgatctgctctttgtaaagttttgatctagtctcataatcaccttccatcataacaggtgttacgaatccaaattcatcttccagttccggaacgtttacgacttcaatctctccgtatgattctttcagctgtggaatcagtttttctttatctcccttaattctcacaaagaatcttctcttggaatccgccttatcttccagttggagcttttcttctttccacattgtcataatattacggttcagatgttttgcttcgtctaccacatctgcaactacggcgcttgcagtcggaagttttcctgccccgcttccatagaacatcgcatctcccagtacatttccatgcacaaagattgcattaaatacatcattgacattgtagagcggatgatccggatataacatacatggtgctacgatcgcatgcagtctgttgcccgcataacgtctgctggacaccagcagcttgatcgttgttcccattgcctttgcatatttcatatcttctaccgtaatctctgtgattccctcacagtagatatcttcaaaatcgacctgctgtcccgagatcaaggatgacaggattgcgatctttctgcaggcatcgtaaccttctacatcagcttccggatttctttccgcatatccatttgcctgtgcttctttcaggacggtatcataatctgccccttcgtaaaacatcttagacagcatataatttgtcgttccgtttaagattccggtgatctcctcgatctcgtctgcagtcagagaagaattcagcggacggatgattggaataccccctccgacacttgcctcaaacaggaaattaatattatgttccgctgcaatggaaagcagctctgctccgtgctttgccaccagtgccttatttgatgttgccacactctttccggcctgcaggcagcgttttacaaatgtatacgccggttcgataccacccatcacttccacaacaatctgtacctcttcatctgatacgatcgtctcgaaatcatgtatgatcttgtcctgcaccggatctcccgggaaatctttcatgtccagcacatatttgatattcagttcttcaccgattctctgattgatacgtgccccgttggtattgatgacttctaccactccggaacccactgtcccgtagcccattactgctatattgatcatatattccctccctttagccgttcgcgatcttcttcaggtatgcattgataaatgaatcaatatcaccatccattacggcatttacattactgttttcctcatttgtacgatggtctttcaccagtgtatatggctgcataacataagacctgatctgattgccaaatccgatatctttcacttcaccccggatatctgatactttttcagcctgctcctgctctttcatgagttgcagctttgcttttaacatctgcattgctttttctttgttgtggtgctgtgaccgttcattctgacactgtaccacaattccggttggcagatgcgtaatacgtattgcggaagacgtcttatttacatgctgtcctccggcaccacttgcgcggtatgtatcaatcttcagatcatcatctgcaatctcaatatcgatatcatctttcagatccggcagtacatcgcacgatgcaaaagatgtctggcgttttcctgccgcattaaacggtgaaatacgcaccagcctgtggacacctttttctgatttcagatagccataggcattctcaccattcacttcaaatgtaactgctttaattccggcgatatctccgtccaggaaatccagcacctgaagtgtgaatccctttctctctgcccaccggctgtacatacgataaagcatacctgcccagtcacaggattctgttccgccggctccggcatgtatcgtcatgatcgcattgcaggaatcatattcgcctgacaacagtgtctggatcttcagcttttcaaacacttcttcaaatgtatggatctcttcctccagttcttttaccatctccggatcttcatcttcatatcccatctcgatcaaaagaccgatatcttcataagaactgtagagattatggattgtctccacaagttctttcagattcttcaattctttcatcagttcctgtgattcttccggattatcccagaatccaggttcttctatctttcgttccagttcttcgattctccgctctttccctgcaacgtcaaagtgaatccctcatttcggcaagaggttcttcataagcgttcattattgttttgaactgatctaattcaaccacatttccacctctttcttttcttatattcttctttatccggcagccgggttatccctgccgccgtcatctcatatcatatacgtctgcattctgaaattaattcttccgtccgcagcactgtttgtatttctttccgcttccgcacgggcatggatcgtttggatatactttcttttcggcacgtttcttcggctcacgtactcctgtatcatccttgttcgttccggttacttttgcaacctgttctctttctaccttctgttccagtttgacatgcaggatcgtacgtactgtatcttcctcaatgcttcttgtcatctcatcaaacatctcgtatccgatcatcttgtactcaacctttggatctctctggccataagcctgaagaccgattccctgacgcagctgatccatatcatcgatatgatccatccattttgcgtcgatcactttcaggagaacgacacgctcaatctctcgcatatgctccggctccggaaattctgattctttcgcctcgtaaacctttgccgcacgttctttcagcatatgcttcagttccgtctgactgatatctttgacatcttcttccgtgattacttccatcggaatcgtattccggatcgtcagattcaattctgtcagattccactcatcataatcctgatccggactggtcaccatgtctaccgcgttttccacataatcattcatcatgtggaagatagaatcgcgcatattatctccatccagcacgtgacgtctttcttcgtaaataatctctctctgttcgttcattacctggtcatattccagcagatttttacggattccgaagttgttgctctcgatcttttcctgcgctttttcaatcgcactggaaagcatcttatgctcgatctgttcgccgtcttccacaccaagtgtattgaacacattcatcagtctttccgatccgaacagtctcatcagatcatcttccagggaaatgtagaatctggattctcccggatccccctgacgtccggaacgtccacgcagctggttatcgatacgtctggattcatgacgctcggttccgatgatcttaagacctccggccgcccttgcttcatcatccagtttgatatccgtaccacggcctgccatgtttgttgcgatggttaccgcatcatggatacctgcctgtgcaacgatttcagcttccagttcatggaacttggcattcagtacgttgtgtttgatgccgcggcgctttaacataccacttaacagttccgaattgtcgatcgtgatcgtaccaaccagtaccggctggtgttttgcgtgcgcctcttcaattgcatcgcacacagctctgaacttttctttctgtgtcttatacactgcatcttccagatcctgacgctttacaggcacgtttgtcggaatctcaataacatccattccgtaaatttcacgaaattctttttcttctgtcagagctgtacctgtcatacctgactttttcgtatatttattgaacagattctggaatgtaatagttgccagggtcttgctttcccgcttaacctttacatgttcttttgcttcgattgcctgatgcagtccgtccgaataacggcgtcccggcatgatacgtccggtaaattcatccacgatcagcacttcatcatcttttactacataatccttgtcacggaacatcagattgtgtgcacgtaatgcaagaatgatattgtgctggatctccagattatccgaatctgcaaggttatcgatatggaagaacttttcaactttctttacaccatcttcggtaaggttgatattcttctccttttcattaacaatgaaatctcctgtttcttcaatgtcctcacccatgatggcattcatcttggtgaattctccgcttgcctcaccacgttccagctgacgtgcaagtatatcacatgcttcgtaaagttttgtagatttctcgctctgtccggaaatgataagtggtgtcctagcctcatcgatcagtacggaatcgacctcatcgatcagtgcatagttcaaccctctctgcacaagctgttctttataaataaccatgttatctctcagataatcaaatccgagttcgttatttgtcacatatgtgatgtcacaatcatatgcggcacgtctctcatcattatccatgctgttcagtaccacacctacagtcagtccgaggaattcatgtacctgtcccatccattctgcatcacgttttgccagataatcattgacagttacaacatgtacgccttttccttccagtgcattcagataagacggcagagttgcgaccagtgtcttaccttcaccggttttcatctctgcaatacgaccctgatgcaggatgattccaccgatgatctgtacgcggtaatgcttcattcccaacacacggcttgccgcttctctcactactgcataagcctccgggagaatatcatctaaagtctcgccattttccagacggtccttaaattcttttgtctttgctttcaattcttcatctgaaagccgctgcatatcttcatccagtgccataaccgcatctgcgatcggatatactcttttcaactcattctgactgtgagttccaaatattttctgtataatattcattcgatgtatactccttatttctctttaaggccgtgaaacgaccactttatccattattttatcactatccatacctcaattcaactgatttataaagtgttaacactttatttacgacctgtttataggggattactttttgattccgcatggcacattaatgatattcttttatcacttcatacggaatcctgccaccaaagagatcaagcgcacttccaatcgtaaaatcaacctttccgtttccggttctgcgtatctgttccagatcctccatacttccgatacctcctgcataagtcaccggaatgtctgcctgcttcaggatctctatcagctcctgttctattccggaagctttcccttccacatccacaccatgtaccagaaattcgtcgcaataaccggacagtctgccaaggatcttcgttccaagctccacattggtaaatgtctgccagcggtcagttacgatataatatcttccgtccttcttcctgcagctcagatccagaaccacatgttcttttcccactgccatacataattttttcagattatcccagtagatttcaccatttttgaatacataagaagtcacaatcacatggcttgctcctgcccggatatattccgaagcattgtctgccgtaattccgcctccgatctgtaatcctcccggatacgcatgcaatgcctttaatgcctgtttttttgtctgtccgtaatattccgacgatgccggattcaggagaatgacatgtccccctttcagtccgtcttttttatacatttccgcaaaataatcggctccctgatctgccgcgaaattctcttccgcctggtctccctgatcccgaaggctccctccgacaatctgttttacttttccgttatgtatatcaatgcatggtctgaatttcataaatgtttatctcctttttgcgttttcaaccattttaccacactaaagtacagccgtccagtttgccgcgaatgccccggacaacaacgaaggatgccggaaggatatttttccttcaccccggcatccttgttttgtactttttgtcttaccttgcagcaatcaggtgtcccttttcctatctggtattatccgtatcattttttcctgtatcattttttcctgtatcgtttttttccgtatcgtccggatccagatcatctacgatgtcatccacaccgtcttctacaccatcttccacttcatttactgcgttatcatctgtattatttgtattatttccacagccggtcagccccgacattgctcctgcacacattaatatcagcagcatttttttccattgtttcattgtacaatcttcctttcgtatatttttcatctgccatcaagtattacctgtcatcagtaatatctgcattttttgaaaatatatacaaaatccgtatgctgctgatactggtatttttttacatttctacagtctctctgctatcacaccacttctgtatgctgcaaggagcacttccaaatctgcgatctgttctttcagatgtcttcccacatcggtatcttccacttttttacgttccaatgtccgtttaactacggtactgtctgaatgtatatcactttccttctcaatggccgcttctgtagattcaaacggctcatgcgcagccaggatcagtccataagaattgtaaatcaatgtatatcctgcaatacctgtttctttctgatacgctctcgaaaatccaccatcgatcaccagaacttttccgccgcacttgatcggtttttccccatctttgcattttaccggtacatgaccgttgataatatgcgcatcttcattttccagtccgaattctttcagtatatggcagattaccttttcatcttccagcaacagataatatggatttttcttctctttatgtgtctctttttctgccaggaaataacgttcgaacgtcgccatcttgtctttaccgaacagtggtgaattctcgctcagccagatataccacataatgtcttttccacgttctttttccttggaatccatagcatagaatccttttcttacataactttcaaggacttcatagagacctttccccttatatgtatgaccgaaaatcctcacactcttcagattgccatcttcttttaatggtacacagccatgatataacagatttccattatacactttatataatccgcctttgttcaacaggaaatgcatatggctctgtaatttttcacagttttcaaatgccctttccaaacgctccataatatcctcttcttctttggtaagtgcatatggctttttcgggtcaattgtcgggaaattcgaatccagcattttatattctttcccatccagttcaattgtacccttttcatagtcaatatgatgcaggagattgcgtttatccagtttaaatcccggatttttcttgataatctgcccttctaccttgaactggatcaccgaaatcgctttgtgcatcttcacatccagcagcatctcacttgcactgtaattcggactgccttttaatttgaaacattcgcacggatcatcccgatatgtattcatggcaaatgttgccagcggaagcagattgattccatatccttcttccagaatgtccagatttccatatctcgcacagatacggatcacattggcaatacatcctctctgcccggctgccgcacccatccacaggacatcatggttgccccactggatatctaccgaatgatagtccatcagcttgtccatgataatatgcggtcccggtcctctgtcataaatatcccccacaatatgcagatggtctaccgtcagccgttggatcagttcactcatggcaataataaatttctctgcccttccgatgcggatgatcgtgcttacgattgcattatagtaagactctttatccgtcatatcctttttctccgtgatcagctcttcaatcacatatgcaaaatctgcgggcaatgcttttctgacctttgatctggtatacttgctggcggttcttttgcagatttcgatcaggcgatatagtgtgatcttataccagtcttccatattcttttccgtcttcttgatccggtccatcttctctttcggataataaataagagtagcaagcgtctgtttgtccctgctactcaaagtattaccgaatacatcatcaattttacggcgcacagaaccagagccattctttaaaacatgtgcgaatgcctcgtattccccatgaatgtccgtcagaaaatgttctgtaccctttggcagatttaagatcgcctgcagattgatgatctctgtagaagctttggcgatggtcggatacagttgagaaagtctttccagataacgttcctccaattgtctcataattacctcccggtctcccctttattttttaagatgccgggattgtgtgagcacaaagcacagaacaatccaccggcatcatagatgggactttagattccaatatcttatatcatatcacattttagaactggatcacatctgacatatcatatcttccggccggttttcctgccagaaactttgcagcctccactgctccttttccaaataccgctttggaatacgctgtatgtttgaactcgatcacttcatcctgccctgcaaagagcacctcatgatctccaacgatcgttcctccgcgtacagctgaaattccgatttcttttccgtcgcgtttctggcgcacctggcttctatcatatacataatgatactgattatccgctgcttcattgatagaatcagccagcgcaagtgcagtaccgcttggtgcatccagcttctgattatggtgcttctctaccagttcgatatcatatcctgccggtgaaagtaccttagtagcatcctgaaggatcttcagaagcaggttgattccaagtgacatatttgcagattttaaaactgcaactttctttgcagattcttccacctttgcaagctgctcttctgaaagtcctgttgtacaaagtacgaccggcacctgcttctccacgcaataacccaacaattcatctgctgccgctgcattcgaaaaatcaatgataacgtccgcttccacatcgcacgcaccaatgttctcaaatacagggtactcatttggcactttggtgtatttatcaatacctgctacaagttcaattccttctgtgttcttgataatatctgtaataacacgtcccatatgtccgttacatccatgcataatcgcttttaccatattcttgtcctcctctgtatacatgcttcttccgggcgtatgccggtaaaaacaaaggataccatagacgtatgatatccttctgtctttttattatactaactgaataccgaaatctttcattgcctgagcaagattcttctcatgttcaggggatatctctgtaagcggcatgcgaagcgggccacagtcgattcccatcagctgcattgctttcttaaccgggattggattcacttcacagaataactgatcgatcagagggagtgccttcagctgaagttctgcacttcctttcacatccccttcaaaatacttctcacaaatgtcatgtgctgcatccggtgccacattcgacagtacagagatcacaccttttcctccaagtgataataccggcacgatctgatcatcatttcctgaatagaggtcaacattaccgtctgtcaggttcatgatctttgcaacctgtgagatatttcctgatgcttctttgatgcccacgatattatctacatcttttaccagtcttgcaactgttgcaggttcaatattacagcctgttctgctggcaacactgtacataatgatcggtgctgtcacttcttttgctaccgcactgaaatgtccgataagtccgttctgtgttgctttattgtaataaggtgtaaccagaagcagaccgtctgctccatactcggaagcttcttttgacatgtctattgcagtacgtgtacaattggaacctgttcccgcgataaccggaactctcttattcacacggtcgattgtaaatttcacacactgcatgtgttcttcttctgtcatggtagcagactctcctgttgtaccacagattacaatgctgtctgttttatgtgcacaatgaaactcgatcaactcatcaagtctgtcatagttaatacttccatcttcattaaatggtgtgactattgccacgccggctcctgtaaaaatagccatagtgatcctcctgactttcatataatctaatgaaattctatcatcaattaaatatgatgtcaatccgaacccttatcgaaaattcatcctttacaccggctcatccatacattccagcttgctgaccgatacctcgtaggcaactcttttctgtgtttctgtttctgtgatcttcttcgtatattcacggctctgaattcttccaaccacctgcacgtgctccccaacttcaaatgcagaagcgaatctggcattccttccccagcagatacatggaatgtaatcggatttcccgtacggtctgttcactgccagcaacagatctgcgatttcccttcccagcggtgtttttctatataccggctgtttacagatatatccatccagtaagatttgattcgtctttgccccgtcaagctcttcttcaataaaaaagagttctctgacaaaaacagaaagaatcaatctgtttttcatctcttcatgcctgttgtaagaccggaattgtccgtttaccataataaattcccctgtataatctttcgaaacatctatcagacgttctgaaatcatcagcggtatcctgtctttggaattactgagtcttttcacatccacttctaccatataaaagccttctccgaatacttcatggctgaataaaaacggggatacgatttctcccatcatagttacctggttgttctcaatcatcttatctgacataattttgtaatctcccttcctctggatcgtattttaagtcattacaaagtctatgaatcaaatcagcattttagaactaaatacttgtaaatttcaaaaaatgtgataaactaatgtggttgcagataataataggtagagaaaaggaagattcgtaatgaagacaaaacgtgaagatgtacgtaatatcgcgattattgcccatgttgaccatggtaagacaacattagtagatgaattattaaagcaaagcggtgtattccgtgaaaatcaggaagtagcagaacgtgtcatggactctaacgatatcgaaagagaacgtggaatcacgatcctctccaagaatactgccgtcacctataacggtgtaaaaatcaatattatagatactccgggacatgctgatttcggcggcgaagtagaacgtgtccttaaaatggttaatggtgttatcctcgttgttgatgcgtttgagggtgctatgccgcagaccaaatttgtactccgcaaggcaatggagttaaaacttccggtcatcgtatgtatcaataagattgaccgtccggaagcaagagccgaagaagttatcgatgaagttctggaactgctcattgaccttggtgcttctgatgaacagttagactgcccattcgtatacgcatccgctaagaatggtgtggctgcacttgagatttcggatgaaatgaaagacatgaagcctctgtttgagaccattctggattatattcctgcaccagaaggtgatccggaagcaccgactcaggttctgatcagtacgatcgactataatgaatatgttggacgtatcggtgttggtaaagtagataacggtacgatcgcagttaaccaggacatggttgttgtcaaccatcatgatcctgacaaacagaagaaagttaagatcagtaaattatatgaatttgacggtctgcagaaagtagaagtaaaagaagcatctatcggtgcaatcgtggcaatttcaggtatctctgacatttccatcggtgatacactctgctcacctgaaaatccgacaccaattccgttccagaagatttctgaaccaacaatctctatggatttcgttgtaaatgacagtccgtttgccggacaggaaggaaaatatgtaacttcccgtcacttacgtgatcgtctgatgcgcgaactgaacacagatgtcagccttcgtgttgaagataccgaaaacatggacgcattcaaagtatccggacgtggtgaacttcacctttccgttctaatcgagaatatgagacgtgaaggatatgaattcgcagtcagcaaagctgaggttctgtatcacaaagacgagaatggtaaacttcttgagccaatggagattgcttacattgatgtacctgatgaatacactggtgtcgttattgataaactgagccagagaaaaggtgaattacagacaatgggtgctgccaatggtggatatacacgtcttgagttccgtatcccatcccgtggtctgatcggttaccgtggtgatttcctgacagacacaaagggaaatggtatcatgaacactgcattcgacggatacgctccatataagggagatatccagtatcgtaaacagggatctctgattgcatacgagaccggtgagtctgtaacttatggtctgtacagtgctcaggagcgtggaacactcttcatcggtgccggtgaaaaagtttattccggtatggtcatcggtgaaaatgcaaaaacagatgatatcgaagtaaatgtatgtaagaccaagcatcttaccaatactcgttcttccagcgcagatgatgcacttcgtctgacacctccgacggtcctcagtctggagcaggcaatcgacttcatcgatacagatgaacttctggaggttactccggaatcactccgtattcgtaagaagattctggatcctaagatgagaaaacgtgtaaaccggtaatctataccccaccggataaaagagacaggaaaacctgtctcttttttttctgtaaatactcctgcaactcttttttatatcaaaatatgtattggcaaatacattcttttcacttatactgaaattacagcggaaatctattatgagaaaggaatccaacgaatgaaagaatttatctctcacattctcaaacaggtggcggcgattttggagtatgtgatcgcttttatgcttgcgatcggtatcattctgctttgcttccgtatggtatgttcacttcagaatatccctcatctgaacacctatccaaattacgatgatcttcttgaggtttgttttaatctgatcatcggtgtagagctgatccgtatgatgtattcgcattctccaagcacagtatttgaagttctgctttttgcaattgcgagacatattatcatggaccactcttctatctacagcagtctgatcggggtctgctcgatagcagtcttattcgcaacaaggaaatacctgttctcagaattcgatgttgcagatgaaactgtatttcgggcctcaaccaaagctaaggttgtcaataaaatcctgagtgtgaacattcctcataaaacagatgacactcttgcggatgtgttgctccctcatctcgacgaacacaatatcactcctcgtgtcggtgcctgttattacttccccgactgcggtctacgtgttgcgaaactacatgatggaaaaatttcgagaattcaggtaattcgtgctatacattaacgtccaaacatgctatactacatatatcagatagattgacggttcgaataacaattgtcagattttatttttcttatttgatgattgtataacgtacatttatttgaaattatgtcgcaaaggagttgggcatcatgaaatttattattattggaaagaacatcgatgtaacaccaggcttaagagaggccgtagaaagcaagttaggaaagttaggaaggtactttactccgaatacagagattcacgtaaccttaagtgtacagaaaggacatcagaaaattgaagtaacaattcctgtaaagggtggtctggttcgttccgaacaggaaagttctgatatgtatgtatcgattgatcttgtagaagaagtcatcgaacgtcaacttcgtaaatataaaaataaactggtagcacgtgaacaggaaggcggtaacttcaaacaggaattctttgacgccgaagataatattgaagatgacggcgagattaaaatcgtacgtaccaaaaaattcggatttaaacctatgtatccggaagatgcatgtgtacagatggaacttcttggacatgatttttatgtattctgtaacgcagagtctgacgaagtaaatgttgtatatagacgtaagaacggaacatttggattgatcgaaccagaattttcttaaaattctatataaaatgcaacacaatacctgtaatgcaggatgcaaaaaagagacggcagcctatcatgccgtctcttttttatttcctgtatgcaccagaaaccatcaaagcaattattccaaaaccgttggcacaccgtcaatctcagcataataacactcttctttcggtgtcatatctgcctgtgcgttcgtcccttccgtaattgcatgcatcacctgttccagttccgtcttcgggatcagtacttccaattctactttatccgtatataccgtatccagtatcttcagctctctctgggccagaatgtactggatcttaccgaatgttgtataatctgtctctatatgaagtttcacacccagaatcttcgttatcacgaccgatgcccgcagaccggctttcacagcttgtgaataagcccgaaccagccctcctgtcccaagcagtgtaccgccaaaataacgtgttacaaccacagctacattcctcagttcatttccaagcaatacatccaacattggttttccggctgttccgttcggctctccgtcatcactgcagcgctgaagctgtcctctctctccgatcacatatgcaaaacagttatgtctggcatcccagtatttcttttttgtcttttctataaattccagtgcttcttcttcattctccaccggtattacagttgcgataaatcttgattttttttctacaatctcatcttctccgccctgatagatggttctgtattctggtaacattttgtcgtcctttcgtataatttgtaaatttatacataatataatacctaatttcttaagattttcctagtctaatatgaagttttcatttttttctttataaaatagtgtacatttgctataataacctggtataaaggaggcctaaacgcatgaattatggaaagaaaaaggctgcgaaaaggcagaaaaaaataacgtccaaatctacgatgcagggaaaacgtatcgttgtccgtttattcaaagcattactgatctgtattgttcttgcagcagtagtcggagtagccggcggcggtctttttataaaaaagatcattgatgatactcctcatgtctccgcatctgacgttaaaccgaaaggatttaccactttcgtctacgccgatgacggcagcacagagattgaacgatttgtatcttccggttctaacagggtatacaaatccgttgatgagatacccaaagatctgcagcatgcttttgttgcgattgaagatgaacgtttttacaaacacaacggtatagatctgcagggtattgcccgtgctgcagtagtcggcattgcaagaggtggtaatttcaccgaaggtgccagtactcttacacagcagctgatcaagaacaatgtgttcccgaactttaccaaagaaaaaacgttttatgacaaattccagcgtaagatccaggaacagtatcttgctttacagattgaaaagaaaatggataaaagcgagatcattgaaagttatctgaatacgatcaatcttgggcagaactgtctcggggttcaggctgcatcgcagcgttatttcggaaaagatgtatctgacctgaccttatctgaatgtgcagtcattgccggaatcacacaaagtccaagtacttatgatccgattactcatccggataacaataaagtaagacgcaataaagtattaaagaatatgctggaacaggattatatcagccagaaacaatatgatgaagcacttgccgatgatgtatatgcgcggatccagacaaccaatactgcttctcaggcagataatacctatagttattttgttgatgcacttgcccagcaggttattcaggatctgaaagaccagcttggttatactgatacgcaggcttataatgctgtttacagcggcggtcttagtatttattctacacaaaatcagaccatgcagcagatctgcgatgaagaagccaataatgattccaattatccgggactgaaagaatatggtttggattatgcactgactgtaacccgtgccgatggatcaacggaaaattatggcagcaataacatcaagaattatgtaaaagaaacttacggaaaagatcagggacttttatattccagcgaagatgctgccagagcaatggtcgaagaatggaaagcaacaattgccagggagggagatacttatgatgaacgtatcacgatcactccgcagccacagtcttctatcacgatcatggatcagaagaccggacagatcaaagcaatggtcggcggacgtggagaaaaagcttccagccttggtcttaacagagcctaccagggttctaagagacagccgggatctacattcaagattcttgcggcttatgcaccggcattagattcctgtgacaaaactcttgcaacaacaattgatgatgaaccatatacactgaaaaacggacaggttttaagaaatgccaataagcaatatggcggtactacaactctccgtgaaggtatcaaacgttccatcaacgtagtagctgtaaaattaagtgatgagatcactcaggaattaggctatgagtattgtcagaaatttggaatcagtactcttgtaaaaaataagacgatcaatggaaaagtgttcgatgacagcacttcccagactcttgctcttggtggtatcacagaaggtgtctacaattacgaaatgtgtgcagcatatgcaacaattgccaacggcggcgaatataataaaccaacgctttacagcaaagtagttgaccatgatggcaatgtccttctggatggtaccggcgaatcacataccgtactcaaagacagtacagcataccttctcaccagcgcaatggaagatgtcgtcaattccggtaccggtactgcatgccagcttcctaatatgccggtagccggtaaaactggtaccacaacttccaacaaagacttatggttctgtggatttacaccatattatacctgtgccgtatggggaggatatgacgacaacaaggaatgtgattatgacacaagtttccgtttcagactctggaaaggtatcatgagccgtattcacgagaatctggaagaaaaagatttcaaagttccttcttccgttgaacgtaaaagcatctgtacaattacaggaaaactcgcaggaagcggatgcccgtctattacagaatattttgcaaaagacacactgcctaccgaaacatgttccggacatggatattcatacggaagcaaatcgaactcttccacagaagacgacagcaattctactgctaatatttctggcgattccaatagagaaaacggcagtaattcaacgaccggcaatacaaccggtaacacagcaaccggcggcgatacaaccggcggtactacaacgggcggctcaaccggtagtactacaggtagttcaaccggtggttcaaccggtggttcaaccggcggtactacaggtggttcaaccggcggttcaaccggcggtactacaggtggctcaaccgacagtactacacctcagtaatatatagaaaaatgcgggatagttaaaaccatcccgcattttttatacatatttttttgattgtaaaatcaatctcatttttccaatatcctttatgaaagaattaatttagcagctccacagattcctgcatcattccctaatgtcgcaaggacaaattcggtatctttgttagcaaaaaaagctctctctttaaagttcttttccacatactctatcagtacttcacctgctttggatacacccccgccaatcacaattgctgacggatctgccactgctgccaaattagccattgcatgtccgagatattttccaaattcttctgcaatctcttttgccactgcatctccggctttcactgcatcaaatacagtctttgcactgacttcctgctctcttaatactgacttggcatcatctttggcaagacggatattcgccagtctggtaattcctgtggctgatgcatattgctccagacatccggtattaccacatccgcaatgatctgtctcttcataattcacacagagatgcccgatctcaccaccggcaccatgcgctcctaccaatggttttccatcaatgataattccaccgcctacacctgttccaagcgttaccataacgatatttttgcgtcctttgccggctcccagccacatttctccaagtgcggctacattggcatcattaccgatctcggctctcatgccggaaagctcttccatctctctttttacttctttatatccccatccgaggtttgcagtgttctgtaccacaccttctgtattcaccggtgccggaactccgactccgattccttccacctcatctctgtcgatcttcttttcttcaagcttttcccttaacgcctctacgatatccggaagaactgcctctccctgattctctgtacgggtcttaatctcccacttatctacaatctccccatcggtcgtaaacaaacctaattttactgttgttcccccgatatctacaccaaaacaatatttcattttgctactctcctatttttttgttagattctgctgtacacgcttgtacagttcctgtgctgcattatatcccatctgtttctgtctgtggttaacggccgctgtctcaacgataatcgccagattacgtccaggacgtattggaagatgatgacacaccactttatttccaaggaattctgtatactcttcttccagtccgagacggtcatattctttgttcttattccactcttcaagcgtgataacaagatcaatattctgtgtctccctgacactcagtacaccgaacaatgcttttacatctacaataccgataccacgcaattcaatgaaatgtcttgtgatatccggtgccgatccaaccagtgtctcatcactgactctgcggatctctacgacatcatcactgacaagacggtgtccacgcttgatcagttccagtgcggcttcactcttaccgattccactttcacccatgatcagcacaccaacaccgtatacatcaaccagcacaccatgaatagaaatgcatggtgcaagttccacattcagccatcggatgatctctgctgtaaattccgatgtcttcttctctgtctggaatacagggatatttgccttttctgccatctccagaagcatcttttccggtggaagattcctgcagaagatcaggcaaggaatcttataagaaagcagtgtctcataaatccgctttttcttatcttcatctgtcatcttctccagaaatgtatattctacataaccaatgatctgtacacgttctgaatcaaaatgttcaaaaaatcctgtaagttgcagtgccggtctgttaatatctggtatctctacatctttatccgacagatctacatccggtgttaaatttttaagattcattttttcaacaagtgtttttaattcaactttattcgccatattcttctacctcacacgtattaaaaatctctttaattattataccatacttaatgattctggtgaaaaaatttatatacttcctgtgcagatttttcattcatacttggcagttcttttaactcttctactgttgcattacggattgcatcaatattctcaaagcatcgcatcagatcttttcttcttgcagggccgactcccggaatatcgtccagcacagaatgcacctgccccttgctgcgcaattgtctgtgaaatgtaattgcaaaacggtgcgcttcgtcctgtatcctggtaatcagccggaaacattccgagttgcggtcaatcggaagttcggtattattaaaatacagtcctctcgttctgtgattgtcatcttttaccattccacacacaggaatatgcagatgaagcttttccagtacttccagtgctatattcacctgcccccgtcctccgtccatcatgatcagatccggaaatatctgaaagcctccggtttcactttcttcctgctgttcacgcaatccatgcccaaatcttctggtcagtacttcattcatactggcataatcatccggaccctgcacagttttaattttgaatttgcggtaatcgttccgttttggtttcccatgttcatagactaccatcgatccgacagaatcgaatccgttcgtattggaaatatcatatgcctccatgcgtatgatgccttttagtcccagtatcttttccagttctttcactgcaccgatcgttctttcctcttcacgtttcagacgttctctgtcattctttaacaccatctgcgcattcttttgtgccagttctaccagtttttccttcgttcccttcttcggaatgcgaagatgtactctgcgttctctccttgccgtcagccattcttcaatgatatcctgatcttcaatctcttccggcagcatcagttccgcaggaatatatggtgtgcctgcatagaactgcttgataaagcttgacaatatctcgccttccgtatcattttctgcgctcttcagataaaaatgatcccgtccgatcagtcttccgcttcgaataaaaaatacctgcacaactgcatcttctccctcagaagccattgcaatgatatctctgtcatctcctgccgtatctgtgattttctgcttctgagcaaccttctgtacacttgtaagcagttctctgtattcaattgctttttcgaactccagactatccgatgctgccatcatcttttcttccagttcttttaacaccagatcataatgtccattcaggaaacgtacaacttcgtctatggatttccgatactcttcctgagaaatgtatccctggcatggtgcctggcactgatggatatgataattcagacaaggtctctctttccctatgtcttttggcagcgaacggttacagctgcggatatgataaagcttacggatcaattctatcgtatctttcactgcgcctgcactggtataaggaccaaaatattttgccttgtccttcttcatctgtcttgccagcataaccctcggaaacggctcatttactgtaacttttataaacggataactcttgtcatccatcagcatagtattatacttcggtctgtgttcctttatcagattacactccaacaccagtgcttccaattcagaatctgtcacaatgtattcaaatctggaaatatgtgtcaccatctgttctatcttggcacctttattcctgctgctctgaaaatactgacggacacggttcttaaggctgattgcctttccgacatagatgattgcatccctttcatcgtgcatcaggtatacacccggttttccgggcagcttcttcagttcttcctgtatgttaaaattctccatatacgtctcctgtatattttttattttctaattctaaacatcttctctgattttttgaatcctattatcgctctttttccgactcttttacaatcaataaagaataatagcctgcctgctccggaacatcttctattctttcatagatccgctcctctggcattccacagttttctatcatctttacattcacatttccgtctttttcttccaaaatcctctttacttcacttattccggatgcggacttcatcagaatctttgtaccggaatagtttagtgccgcttctatcccatagctggatgggattacatgaagttcttctgcccggtcaacaagactgtcatccagtctcgccgctgcagcacaaaaggacggaattccgctgatgatcgttgtctcatacccttttgcttttactatgcggtgaatgtacatataagtcgaatagattgtcggatctcccagcgtcagatatgctacatccttccctttttccagttcttctataattctccctgctgcattttcataattccgatccagaatctgtctgtcctttgtcatcggcgtatccagatccaggaattctttttcttccatattctctatcatctccgctgcaatcctgtagctgaccgcatgtttcctgcctctcgcaggcactgcgagcacttggcattcctttatgatacgtactgctttatatgtcataagttccggatctcccggtccgactccgaccccgaataatcttcccttcatactctttcctccagaatactctcatcctgcctattatataccaggcagatataattgaaaagaaaaaaagatacagggccttctcaaactttaccctgtatctttcctcgtatatctattctctttatacttattcttcttcgcagacaacttcctttattgcttcaacaggttcttcggctgtatcatctgctgatttcataacaaacccttcaccttctaccggattcataccgattcttgcttcttccttcttcggtgcatccggatcaattccttctacttcatggaagatttccataaattcttttccggtgatcgtctctttttcgattaggaatgccgcaatcctatccagtgactgtctgtgatctctcagcagttgttttgcttcttcataagcatctttcagcatcttcatgacttcttcatcaatctcggatgctgtctgctgtccacagttgctgaccggacgtccgtccagataacggttctgaatggattccagaccgatcagtccgaacttctcactcataccatactgtgtgatcatggctcttgcaacgcttgttgctttctcgatatcattggaagctcccgttgtaaccgtatcaaataccacttcttctgcggcacgtcctgcaagcaatccgactaacatcgcctgaagttccttcttcgtattcaggaatttttcttcctccggagtctgcataacataaccaagtgctcccatcgtacgtggaacaatcgtaatcttctgtaccggttccgcatctttctgcaatgcgcttaccagcgcatgtccgacttcatggtaggaaacgattctccgttcttcctgactcataatccggtctttcttctcttttcctacaagtactacttctactgcttcaaataagtctgactgacacactgcatttcttccatgttttactgcattgattgctgcctcattgatcatattggcgagatcggaaccaactgctcctgaagttgccagtgcaatctcttccagattaacagtctcatccatctttacatctttggaatgtaccttcaggacctctacacgtcctttcagatctggtttttccacgatgattcgtctgtcaaaacgtcctggtctcaataacgcaggatccaggatctccggtctgttggttgctgcaagaagcaccagtcctttattgctttcaaatccatccatctccgcaagaagctggttcagtgtctgttcacgctcatcgttgccgcccatctgattgtcacggctcttaccgattgcatcaatctcatcaatgaaaatgatacatggtgccatctgctgagcctgtttaaacagatcacgtaccctggatgctcctaccccgacatacatttccacaaatgctgaaccgctcagtgagaagaatggtacctttgcttcaccggctactgctttcgccaaaagtgtcttaccggttcccggaggaccgactaacaacgctcccttcggaagctttgcaccgacactcgtatatttcccgggattatgcagaaaatctactacttcctgtaaggactcttttgcttcatcctgaccggccacatctttaaatgtcacacctgtctgcttctctacatacatcttggcattgctcttaccgattcccatcatgccgccgccttttgacatacgctttgtcatccagacgatcattccgacaaagaatgcgattggcaggaatgttaagataacgttcattgctaccgcggatgtggtatccggaatctcctgattaaattctacaccggctttttccagacggttggtcagttcgtcatcattcacaactccggtataatattcctgtgaaattccactgtccttatccttcttcgtgacaatcatgatcttatcactctgaatctctacttttttgaccttgccgtcatctaccatcttcaggaatttattataagtaatctcttttgcagaggtcattccctgaaactggaacagtgcaaccacaagaatcgatgtaataactgtgaccaataaaataaacgaaataccttgtttattattcttgttattcttattattttggttgtccattttaatcctcctgtataactaattattataaagaccactatgttagaaatcaataaaaacattatgaaaagattgtaaacttcctatgtgttgtagtatacttgaaatgaaaatgcttatgccgattccggcagattttccactataaaaaatcaaatatattttagatgagggaatgtacttatgaaaattggattcgataatgaaaaatacctgaagatgcagtctgaacatatccgtgaacgtatcggacaatttgacaacaaactgtatctggaattcggaggcaaactttttgatgatttccatgcctccagagttcttcctggattccagcctgacagcaaactccgtatgttatgcgagctgtccgatcaggccgaaatcgtcatcgtcatcagcgctgaagatattgaaaagaataagatccgtggtgaccttggtatcacgtatgattccgatgtactccgcctgatgcatatctatcaggaacttgggctctatgtcggaagtgtcgttattaccaaatataacgcacaggaaagtgccgaattattcaaaaaccgtctggaaaagcttggcatcaaagtgtaccgtcactacctgattcccggatatccgacaaatgtaccttttatcgtaagtgacgatggttacggaaaaaatgattatatagaaacaagccgtcctctggtcgttgtgactgctccgggacctggaagtggaaagatggctgtctgcctgtcacaattatatcatgaacacaagcacggaatcaaagcaggttacgccaaatttgagacatttccaatctggaatattccgttaaaacatccggtcaacctggcttacgaggcagctacggccgacctgaatgatattaatatgatagatccgttccacctggaagcctatggtgagacaacgatcaactataaccgtgatgtagagattttccctgtattaaatgccatgttccagcgcatctacggagaaagtccttacaaatccccaacagatatgggggtaaatatggctggcaactgtatctgcaatgatgacgcatgtagaaacgcttcctgtcaggaaatcatccgcagatactatgcttccaggagaagacttcttctcggcgcatgctctgaagaagaaacttataaattagaaatgttaatgaaccaggcagatattaccgttcatgaccgtccggtagtcgatgcggctctcaccgaatccgagcgtacaggcgggcctgcagctgcactggaactcccagacggctcgatcgtgacaggcaagacatcggatcttcttggcgcatgctctgctcttcttttaaatgcattaaaagaacttgcaggtatcggacatgagatcaagatcatctctccacaggcgatcgaaccaatccagagtctgaaaacaaaatatctgggaagccgcaatccacgccttcataccgatgaagtgctgattgccctttctgtaagtgctgctaccagtgaagatgcaaaacttgcgatggaacagcttcctaaattaaaaggctgtcaggctcatgtatctgttatgccggggtctgtagacatcaaacaattcaaactgctgtctattcaggcaacttttgaagcaaaatatgaaaaaaactctgtattttttaataacaaaggtgtataatcttaaagtatttttttttgaacacttatataacagagaaactaattttgacttaaggaggaagttatggcagtaaaatacgtattcgttacaggcggtgtagtatctggattaggtaaggggattacagctgcatctctcggacgtctgttgaaagctcgtggttacacagttacaatgcagaaattcgatccatacatcaacattgaccctggtactatgaaccctgtacagcatggtgaagtatttgtaactgatgatggtgctgagaccgaccttgaccttggacattatgaaagattcatcgatgaaagtctgagcaagaattccaacgtaacaaccggtaagatttactggtctgttcttcagaaggaacgccgtggagattttggcggaggaacggttcaggttatcccacatattacaaatgaaatcaaatcccgtttttatcgcaatccagccgctgagaatacggaaattgccattattgaagtcggcggaactgttggtgacatcgaaagtcagcctttcctggaagccattcgtcagttccagcatgaaaaaggacgtgaaaatgttatcctgattcatgtcacactgattccatatctgaaggcttctcaggaaatgaagacaaaacctacccaggcaagcgttaaagatcttcagggaatgggaatccagccggatattttggtatgccgttccgaatatccactcggtgtcggactgaaagacaaaatcgcattattctgtaatgtaccgtctaatcatgtactgcagaacctggatgtagaatatctgtatgaagctcctcttgcaatggaagaagagaatcttgcaggtgttgtatgtgaatgtctccacctcgactgcccggaaccggatttaaaagactggacagaaatggtcgactaccttaagaatccaaacaccgaagtcacagttgctttggttggtaaatatattcagcttcatgatgcttacatcagtgttgtagaagcattaaaacacggtggaatcttcagccgtgctactgtaaatatcaaatggatcgattcagaaaccgttactgccgataatgccgaggaattatttagtgacgtaagtggtatcctggttcccggcggattcggtaaccgtggtatcgaaggaaaaatcgaggcgatcaaatatgcacgtacacacaatataccgttcttaggtctctgcctcggaatgcagctttctatcgtagaatttgcaagagatgtcatcggttacaatgatgctcacagtgcagaacttgatccaaacaccactcatccggtcatccatatcatgccagagcagattggcattgaagatatcggcggaactttaagacttggggcttatccttgtgtacttgataagacatccaaagcttacgaaatgtacggaacagatcagatcagtgagcgccaccgtcatcgttacgaggtcaataatgactaccgcgaggctcttacttctcacggcatgaagctctccggtctctcaccggatggaaggattgttgaaatgattgaaattcctgaacatccttggttcatcgccacacaggcacatccggaattaaaatcaagaccgaacagaccgcatccattgttcagaggatttatcgaagcttctctgaaatatcaggaagaacataaataactattaaacgaataaaaacagggaagctgttgctaacgcttgcgtatcatgcaacagcttccctgtttttatctctgtatataacggatccgataacagattttccgtccttataccgaccagcttacagaacttcccttgtccgtctttttcactacaagcttatgatcgatctgttctttcagttcatttacatgtgaaataattcccaccagtctgtctttatccgcaagatcattcagtacacgaattgcctgatctctcgatgcatcatccagagatccgaacccttcatctataaacatcgtatccagatggatcgcacctgctgtattctgcactatatcagaaagtcccaatgccatagacagcgctgccataaaagattctccgccggataaggttttgacatctctgatcgtatctgttgccatatgatacacatccagttccagtccggcctgtccctggcttcccagcttttcaacatctctgcattgcagaatgaattcgccggatgtcatacggatcagcctcttatttgcggcacgtatgatctgccggaaatattgtctctggatataagtctcgaagtccagttttgcacttccactcagatttccattcgccgtcttactcagattaccaatgatttcatactggttctgcagtccactgttcttctcaaaattgcgtctcagattatccctgatttctctattcttttcattgatattatgaagcctcatatattccctgcggatctgctccagcacttcagatgcttcttttatttcctgtttgatctgcgctatatctttcttttctttccccttcagttgctgttccagtaattttctgtttgcttccagttcctgaagttctctctgatatgcttctgtccaccgttctgcttcttccagttccgtctcctttatgcatttcctatgataactctcctcatccgcaaatccctgtgccttcattacctgttcataacggagtttctttttctctgcttctttctgagattgtagagcagatgccttcacggtcttactacgtccttccagttccttttctttattttgcatttctgtcagacgtctggtcactgtctcataattctttctcaactgctccaatgctcctactgtctgtgccagatgtttttctgcttcttctatggtctcatatggcagtttctccttcgcagtctgatattcagcctgtacttttgtatataccagctttgattccgtcaggcattggtccgtttcccgttcttttctttccagttccaccgactgctccgcaatctgtttctgattcttctttaatgctttgcatttttcggaaatctgttccagttgttttaattgttcttctgtttctgcaaacgtctgtcccagattttgcataatctttttccagttagtcttaaatccgtcttccggcgcatcttttatgttcatttgaagcgtctggcagatttcctgtgctgcctggtatcctgcaagacattcccggaatgcagcgacttttatatctcttgttttttctttcctgtctctttcctcctttgcagattctacttctgcctgtgtcggtgcttcgtcactcaataatgtaatctgaggatgttctctggaaccacagaccggacaaggctgtcctgcttccagtgtcaaagccagtattcccgcctgttctttcagaaacttctgatacttcatttcatatttcgcccatgcatgttcataattcttctgttcacattcagcttctttctttgctctttcgcagtcttcctttaattgttcttttctgttttcctgtctgtccagttccttatattgccgcattttttcttctgtctgttgttttttatttctgcattcatttatgcatatctcaacatcttcatgttgctttagaaattcaattatttcttcgctcttattctgcaggatttcattcttttcttttattattcttgcatgatttaaatatttttttatttcttctgcaagtttattcaaagtttcctgctttttattaatactctcatattgcaaaattgcatcctgtatccgcacttttttctcggtcagtacaatctctttttctgtcttttctttcacagcctctttctgatcttctgtaagttcctgcaacaattgtctgcattcctgtaatttcttttgaagactatgatcctgtgtttttaactctgtcagccttttttcttcttccagatatctcttttcctctgttctgacacgttctgcactcttaccgaactgtatctgctccttcataagctcatattttgccttttccgctgttttttctttcagatggcttagtacctgtccatacgaatcaaagagctgatccagaagttctgcttccttcagcagacggttcttatcttccagaaccatctgtgccccgtctgcttcttttttgcaggccttttccaacctgcttccctgtccaatgatttcttttagtatctccgatattctgtctctgtccggaatatcctgtccggatacttctttccattttctgctaagctccgtttcttttccgttctcacacaccggatactctgtcctggccatctcaagcttcatttcctgcagattctgttccagtttgacatataactgtactgcctgtttcttcaattcttcctgtattctgtaataaaagcgtgtctgaaatattctggaaaatatctttttccgttcttttgattcagccagcagaagcttcagaaattctccctgtgcaatcatggaaatctgggtaaactgatctgcatccagccctgtaatttctacgatcttctgatccgtctctctcttctttcctttgaatacacttccatccggcagtgtcagttctacctttggggtctccttcacatatctcagtgacccgtctgcatattttctttttcccaggcgcatatattccggatttcttagtatcttatattgtttcttttgatatataaacgtgtactcaacataagtatccgttccttcatccgcatactggctccgcatcatatttccatctctggtgccgccgctggtcctgtcatacaacgcatatgtgattgcatcaaagatcgtagtcttacctgcacctgtatctcctgtgatcagaaacagtccattgggaatctctgtaaaatcaatctctgttctgccggcatatgatccgaacgctgacataataagcttaaccggtctcatctactccactcccttcacattgtcaaagatttctttcatgattgtctcctcctgcgtattcatctctcttccctgcatctccttatagaattcacaaaaagaggtaaacggatccttcataacaagttcttcatccatttcttttaatttggttcttgttctctgattatctacccggatctctaatatatgggaaaatacccgttccagctgctctttcggtttatatggatcgatctcatccgtcagcgtaatactgatgtaatcctctttttcttcttcaccggcttcttttataatttcttccagcgttccttttttcttcctgacatctctgagcggatgcagtggatagcatgcaatttctggcttttcccctttttcttttaaagtcaccacagtaagacttttggtctgcgtgctctcactgacagaatacttcaaaagcgtaccgcaataccggatctttggcctgctgacgtactgtgccccatgaagatgtccaagcgccacataatcaaattctttcactgccccgatatctacattatcaatccctcctacggaaactacttccgaatcacaggtttccggacttccttccttttctcctacataaaactgatgggaaactaatacatttcttttgttattataatctatctcttctcgtttaatgatttctctcacagcatctgcatatgtctctgggacattgttaacgaaaacgtttcttacatatccaggtttcataaatggcaacagataaaaatctacctctccatatgtatcctgcaatgttactttttcaatatgctcttccggctgctccggaacattccccacaagataaatatgatgccgtctcaaaatctctgaagcataattcagacgatcaggtgaatcatgatttccgctgatgatcagaatcggaattgccggtgtgatctctgaaagtttcgtcaggaactcatcaaatatagtcactgcttccgctgatggaactgacttatcataaatatccccggcaatcacaattgcgtccggatgcaattcttttgcataggcaatgacctcttttaagatcacctgctgatcttcttttaaattataacgatgaagctgctttccgatatgcagatccgataaatggaaaaatttcatacctgtccacatcccttctattttatttgcatctttctctatattacactataatcaacttatctaacaagactatacaaaaaactataatcacagatatgaggtaatgagtatgttaagagagattaatctagatgaaatatccgatgggaaattatacagcaacaacgatatggccaggactgactgcaaaggctgtgacggttgctccgcctgctgtcacggtatgggaagttccatcgtccttgatccactggatgtgtaccggctttccatcaatctgtcaaaaccagtgaatgaactcctggccggtccgctggaactgaatgtggcagacgggatcattcttccgaatctgaagatgaccggaaccaaagaggtctgttctttccttgatgcggacggacggtgtacggttcatgcattccgtcccggaatctgccgcatgttccctctaggacgtttttacgaaaaccattctttccaatatttcttacaggtacatgaatgtccgaaaacggatcgttctaaagtaaagatcaaaaaatggctggatacaccgaatctgaaaacctatgagaaatatattgctgactggcatttctttctgaaagggcttcaggaatacgttatgaatcttacttctgattcttcttcagattctgattcaactgccagaacgatcagtatgcatgtgctgacacagttttatctgacgccttatggggaagacggaaatttttatgaggaattttatgagaggctggagaagtcgcagctttttactcaatcgcttgggatttaatttagaaggcatgactacccggacctgcataaaaagtagaaagccgttcctgttcaggttccgtcggtgggaaatactaaagcgtcaaaattatgctaaaaacgggcttccgaaatttgcaacctgacgatacaaaaatttattattttttattgtcctcttgacggggagcataccactgcatcacccctacagttctggcggctcattttattataaataacctctcttatttctatcaaacaatagtgtttgtatccgcttcaatgccatgagcatttgctccgggaatgtcttagttaaacttgaaagaattagattttcattctcattacacaaatattattagataaccaattcagaaatatcaatgctcgttttatagttttgttttactccgccaggagaagtaataaaaatcgtagcatattccccattttcataaagggtaatttcttttatatctttttcttcatcttggttcgtagtatcgcaataaaattttatggtatatttagggttcatacctatgcttttttctgtctctttccatgattttatatttaaagcagaaataaccttgtctatattatgcttatcatcatactttaccagcaattccttatttgcggcatcatatatctctataacttttacaccttttacataattgtccattctctgcctttttccgccccgccagatacctgtgccggtatttcagctctgcatactctgtgatccgtttcatgtagactgcatcataagctccgcctacagcaccaaccaccggaattccctgtaagaacttcatatacagaagctcttttgacaaagctcccgccgtttgttcgatctgctccttatcctgatactcttccggcagtattccgtttctgataaattcatttactttcccgtcaatctcacaaagtgtatccccataggatactgctccccggatcaataataagataaaatatttttcttccctgctttcatagctgtatccatactgcagagcagtctcataaatattctttaaaatcatccctgtaaataccggaatatccggcagaccgattcccaatacgcccatcccgattccagacacaccggatagcagtaaattctttgttcccgtatctcttgcctttttagaaaaagagcggagggatttggaattctgctttacatccgccatatactgccgcacctgataatcctgctccagttttgtccgctgatacgtcttttcaataaccccggttcctttctcgaaaatcagagcaaatgccttcgcaaaagcggtatccaatgttttctgaagtttcggcggtatcttttcctccagtttctgattcagaatgctctcccttttctctgaacgcttctgaaggaatctctgctcctgtacttccagcttttcccactccttctgaagcggtgtccttttatcaaataatcgcatcttaatacacctccgcaccaaacggcatcaatgccagtttcgccagtttaaactgctgtaaaccaaacgggattccgataatcgtcacacataaagctgtacccaacgccagatgctccagtgcaagaggcagaccggatacaatcagccagatgatattcaaaaggaacgaaccagctccgccaccatactgcacctcttttccaaaggggaaaaaactaagcgccgcaaatttaaaacactgcatccccaccggaatccccacaacggtaatacaccagagacaacctgccagacaccagctcagcccactgactgcgccgccaaacacaaaccacaacacatttcccaggcatcccatatgctacacctccccattcatccgatttttcacatcagcaagtatcttttctatccggttgatggcatcatccacctgttctcttgcatctgcaatcttgctctgcaccatataatctgccaccagcccgtccagaaagaaatccgcaaaggaaaggaagctgccgatttccatgcgcagatccaaggaaacctgcacatctcttaattctctctgaaaacgctgaatatcgcttttcgcctgttccatcaacgcagctgcgtcattcattttagaatgcttcacaaagtcactgataaagcctcctccaagcatatcaaaaatgccccagtttctcgcacttcccaacttatcccttgctgcgtaaaggctctgaagcgcccgctcccctgcctgtactgcttcctgcatttcccgtttcatcatttcgttactcatcgtttatcctctctttctttttagcagactattgcggcagattttctatatttcataataaaaaaagactcctatcatgacctctgccacaataaaagtcttgctatctcatttgctacgggtatctctcgataccggttgtcggttacaaaaccacctctttcaaggcgttcagctactcccttttttgcttgagatgaatataacatattggaaataatttgtcaaatcatgcatttttcttttccaaccgttccgcttctctggcaaatacatgcgagatatcaaacagttccggtacatctgatatggtacacacattcacacaataattgagccatggaaattcttttgtcatctgataaataactgccatggcttttgcttctgacattgcttccaccgaatgatatcccgatccctgaatatgctcaaatccgtttgcttcaaaaaagtcccttacatccgcatatgcattatgccagtcacctttcggataatattcctttagtgcttgtgtattcaggtcaaaattgatgcctttcctctgtaagctgtccatctgttagttccttataaagtctgtaatcaggttctccttttctgttccgttataccagaaacactctaacaaattctctgcaattcctacggagtttttcaactgaaagattgctgcccagaatcttccatagtcctgcttgcgtccccggtcaagataaatcctgcttccaagggctttgactgcacagcttaaatcctcctgctcaaaaatctgatctgcctgttcacacatctgatttaccgtttccggagcgagcttgcttgtatcaaatttaagttctactttatacattatactcatcctttcatacaacaaatgactgagtgactcttttctttctactgtaattctaccatgaaacctatataaagtcattccccattttcacttgctttaatataaatttttccttttattttggaaacacaatctccacacagaactcattcccttctatccgggcgctgattttcccatccatacgaagtaccagctctttcgcaattgataagccgagaccgctggaagtcttactgcgtgcttcatccgctttataaaaccgttcaaacacctgatctacatttattttttccacatgacatacttgattttttatctgtatccggatgttgttttcaacttcttccagtgaaatactgattttcttctccccgtgatccagtccgttttttatgatattctgaaaaattctctggattccctgttcatttccgttcataaacagcagtttatctgtaatctgtatctccggttcaattcctctgcccgtccattcatcgtagtaggaaaatatggtatctttcaaaatcttgttgatacagcaggatgacatttccagatgaaaagaatcgtttttaagttttgtaaaagtaaataattcttccagcatttctttcaggctgccgattctctcctgtatgatcttcatataccgtctctgctcttcctggtcttcacaggtttccattaactgaaaatatccgtcaagggatgtcaaaggagtacggatatcatgtgagagatttgtatatgtatccgaaatcatctcctctttcttcaagtattccttcttttcccttcgcttcagttccagccattcgtttaaaacatctgccaactcaccaatgcctccaaaatccatttctctggtaatcagcatgttgctgtcgtgcttcatcagaaacgacaactggcggcagatgtctttcacctgccgctggtatttccaaaataacattccttgtaccagtatcactgctatcaatagcacgaaccctagttttatcatttagatatctctctttctgaatacccatgctgtcagtaatgtaaccacgattccgaacgccgccgcaatcacaactgccgtcaggcattccttattggtcggtgacatggataaaagtgcaatctttcctgtcactgtatatttcaaaatctggaaattctccacacctgccttctggatcaaatgattgatcactccgtataagacaatcatggtattcatgcacaggcagataacaatcgtcatgctgaacacgttgctgttcaaaaccaccgcaatcgccatactgattagtaccagtgcataatgaagcaaaatctgaataccaaagtatctcagcaactcgcttccattcccccactccagatatccgaagtacatctgctgtgcaataatctgaatgatgaaataaagcagcatggtaacagtcgtatacacaaacaacacggaagctttggaaaagatcaggtttctccggctccttacctgcccgccgatatttttaatataaccgcttcctatatctgcactggaaaacagcactgtaaaaatcaccagaaacaacgccacaaacttcgcctgcaggtttgcatatacctgatcaaagaccgttactttttctcccggctgtgtcggcaggaatacggacattcccatattgatggtttctggtttcactgtttctgcaatgttttctgtctgctgttgttccgcttccttgttcatcgtatcaatatccagtttcgacatggatgtggagaagaatatagctgccgccatcacaatccataccacatacatactttttgtccggaccatccggtacagatccatttttatcatattaagcattttgattccctcctgtcagattcaagaaataggtttccagttcttcactggtaatggaaattccattgaccaaaattcctgcttttgccagttccatattgacattggcgctttcattcaatcgttcaaatatatggatatggctcttatctgtaacctgatagttggtaaatcccattctgtccagaatcgggactgcctgctccggatggattaactctatttcaatccgttcactgcagcgtttcatcagttcttcgcttgtcagctcctgcagaagacttccattatggataattccataatccgttgcaatcttagataattcctctaaaatatgactggatatcaaaatcgtcatattccgttcatctcgcagtctctgtatggtatcacgcacctctgcaattccctggggatcaagcccattgatcggttcatcaaggaccaggagatccggctccccgaccagtgccagcccgattccgagacgctgcttcattccaagggaaaaatgtttcgtttttttctttccgacaccttccagtccgaccgtctctaagatatcttcgatgtatccctttttccgaataccaaacaattcacattttattttcaggtttgtatatgcattcatgttgccatacagccccggtgcttcaatcagacaccccacacgagaacgaatcctctccagttcttttcctttacacccgaacatctcaatctctccggctgtcggtcttgcaagtccactgatcatcttcaggcaagtcgtctttcccgcaccgttccgtccgataaatccatagataacacccttttttatgtgaaggtttactttatccactgccttatgatgaccatactgcttcgtcaatccatttgtacttaataacaattcactcaatgctttcatctccttttcttatctgctgttatcatatcggataaatcctaatcaaacgcaaataaatagtaaaaaaagagtaaagattaagaatgcagacggtagccgattccccatacggtatcaatatattcctcctgcgttactgcttttatctttttccggatattgctgatatgtacatccagtgtctttgtctctcccatatagtgttcatcccacgcatattcaaaaatctcttctttgctgaagacctgtttcggatgctccagtaaaagctccagaattgcaaattcctgctttgtaattttgggaagcagcactccggcaatccggacttcaaagcgctcacggtccagttccaggtttttatatgacacgcttttatgttccggctcctgctgcatatggcggagctgaacctgaatccgggcaagcacctcctgtatctcaaacggttttgtaatgtaatcatctgccccactggtaagaagcccgattttttcatccaatccgtctttggctgtcaggacaataaccggcgtattgccctgtttccgaatctgggcaagcacctcttctcctgaaattcccggaagcatcagatccaatagaatcaaagaaaagcccgccttatccatctggaacagcatcctcgcttccgtcccggaaaaagcctgtaccgtctcataccctgctttctgtaatgccgtatataaaagattattgatatccgtatcgtcttctacaatcagaattctgtttttctgctccatttttctcatccttccattttccgatttaaacaatattatattgcacttttataactatgtccaaaattcttttgatattatccttccacctcgtctacatatgctatatatagttctaattcttttgacatatgctatatcttgtgttaatataatcttgtatttaagtttttgtgctgtcccgtcatgggagtctggaccattcatccagaagcatatgcagtttaagtttggaaaatcgtgtcattatactgccgttttatacggtgctataatggcactttttttattttaatctattttaacgcccaaagaggcagaaaggagaatttttatgtcagcaattttaacaattttagggagggccacaagagatcctgagatgcagcaaggaaaaaattccggtacggaatatgtttctctggacattgcagtttcacagcgaggccaggatggaaaggaagaaaccatttactatcagtgctattttaacaagttccttgcagaacgcttagcaaaagcaggcgtaaagaaaggaaccgggctgatgatctatggtgatctggagcttcatccgttcatttatcagaaaggaaagaatgcggggcaggcaaatgccggtccgaggatcaatgtcaaggactggcactttgtaccatccaaccgttctgacagcaataccggacatccgggtgcaaaccagaacagccagccgaatggtggtgcggcaacgcccggtgcagccggcaatggcagctacccaatgcagggaaatcccaatggcagctaccagaatcaggcaatgcctggcggctatccacagcagggaatggctcctgctaacggtgcctacacgcctcctgcaaatggcggacagtatcaggctccgccaaacggaaccggtcagccacagagcagctacccgccgcagggcagttataccggaatgccaaattacggaggtatgccgggcagtcagccaactgacggctttcaaaatgtgccggaacagatggcatcccagttgccctattaactctcaaggaaccctatgttgaggaattgcatttatcatctttgtgatgatgcagttcctctttttcatgtccggaagcggcgatttcccatccagcttccgggcttgtctaagaatcatgaatcagaaaggaatcagctcatgaaaaaatcaaatcgaaaaaaattcttacagtttgtcgtgcttgtactgtttcttgcagcacttttcgtaccacaggatgccaaccggcttctgattgcaggcattgccctgatcggtatcggagtcacgctgttcagttatcttctcccgcttttcacggaacgcctgaaaaacagggagcataagctacgaaaacgcccagaaagaactcgtcatctggaaggaacacctgatctggaaaccattctctggagacagatcaaattccagattaccggaaagctcaaggaagccttcccggatgccacatgggattttgtgaaagaaccaccgctctcccagatactggatggggaaccattacggattcgcacacggaataccggaagttataattttgcggaaattctcatggatgcccgtggcagtctgacgcttcagatgatgaccattgaatccttacataaaaaggaaccgtcagaaggaaatccggattccagaccagccgttaatcccaaatcatggtattccctgattgggaaaccgctactgatggaattggtcggtgacttacaggcaaggggctatgaaaagctgtttatcaacgagcagggagatgtctatattctgaacggcactgaaccggaagtccggggaaagctggaacatttcccgcccaaagattactggggcgaattgacggagatttttactgaagatgaattgaccacagaagagaccgagcaggcactggaactgtcctggatctcataagaaggaggaacgaatcatggcaaataacatcgtagcaacctgggggttcaaacgcaaactcccggaaccatttgaggattatacggaccatgcaatctttgatgacattgcatccaaatactgtactcagccacggaaaaaatccacgcttcatgcagctaccctgcgggcagtccttgcttatctggagctggaaaacccggttggcagtaccccgccggaaaagcttggggcggtcggtacccaatccaacaattttgttgtggcggaatatccgagcaaaaccggtgatcttcaggtggttgtctacaaccagctaaacggaaagttttacggaggctgctatactcctccgccggatgtggaaagcacaccggaaaaatacgaatttaaagactccaaacagtccggtgcggctctgctgttcgcactgatgccggtttttctggcagatgaagagtgtaatgaaaagtatcaggaattaaaagcgcaccgggacaacggttatcccgatctggacgccgctgcggaaacagcagccgttctctgcgacaacatttaccggagaacccgctatgcatcaggtctcccgaccggtggtgttaagattgaccttccggcaaacggcgtattgtcgctgatcaaaccgttaaatatccagaagggggtctatgcaccaaccgaagtgctccatggagactttcaggtgttacgtccaggaagtggatttaagaaagcacaggcagccatttccagagatgattttgttgggaaatttatcctgaccgcatcccgaaggctgtctccggaagaggaggtatctgttccgacattggcagagtggtacatcatccctccggaaatcaaacggatctgcgaacacgcaaaactgacaacggataccacacagccgatgcggaattttcttttacggggaccggcaggtaccggaaagaccgaaggagccaaagccattgcttccgcacttcaccttccttaccgctgcattacctgttccgcaaatacagaggtattcgaccttttaggtcagattcttccggatgtggacggaaaacgcacccggcttcagcggcagtacccgtcttttcaggaaatccagttagatccctccggtgcctatcagaagctgaccggaaactatgatgaagaaatttctgccgaggacacctaccagaagctgatcgatacgatttttgatgaaatgcacagctattataaggaacacacctccggacagaacttccagtatgtggatacgcctctagtcgaagccatccgctatgggtatattcttgagatacaggagcctacggtcattgctaatcccggtgtactggttggacttaactcccttttagaccgctgtaacagcgtatatcttccaaacggagaaaccatccaccgtcatccggatacgaccatcgtaatcaccacaaacaatgactatgcaggctgtaaacagatgaaccagtctgtcatttcccgaatgaaccttgtgattgatctggatgaaccggatgaggatacacaggtagaacgtgccatggctgttaccggatgcaaggatgcaaaaacggtacgtctgatgacacgcattgtcaaatccatggctgtctactgccgggaaaatctcattacagatggctgctgtggcatgagggagctgatttcctgggtgcagtcctacatggtctgcggggatatccgggaagcggcccgttacacggtgcttgcctctgcctctgccgatgctgagaaccgtacggaagtggaagaaagctgtctggatactgtgcttgctgcgtaggacacgcctatgagaaaagcagcactcacagaagcccagatccgaaagcatctggcagataatctgtcttatctccggcaagccaaaacaccgaagttatcacaaaaggcagttgccagaatcttaaatcttcccccgaaaaccattatgaattatgaaaatgcaaactcctccccgatggcttatgccgtccttcgccttgctgtgtattacggctgcacgatggaggaactgctgacaaaaaatctaagaaaagaaaggaagaatatcacgtgaatcacagccaaagaaatttaaagaaactaatccgggcaaaagaggattccattgcggatgaggagttattcctctccgctgcctatcagaagtaccagacctcccttgccagagccgttaccggacgttaccggtatggactgcaggtactgctggactgggacatttccgaacaggcaggcgttgcatataccgacaattataaggtacatctcaacgcagcgaacccgatcacccagtctttccccacccgtttcttacgttcccagagcctgacagggctcaccgggcatgaagtggggcacttactctattctgatttcacagcccacgctgttcatctgaggagtctggaaaacggttccttctatccgaaggagccggagctatcccttccagcttatcagacagcactggaggagatcaaagaagtgttagaagaaaaggacaaagccggatgcctgacactggcacgatgcgccgcaacttttcaaaacattctggaagacatccatattgaagaccgtatgtgtgaggaattccacggcaccttccgacaggggattgaactcaataacctgcgtatgtccgaacagattccttccatacaggaacaaattgacaaagaataccagccattttccatcattgccaacctgatcctttcctattgccggaccggaaacatcaacaatcccaccggctatcagggggattatctggataccatttccgattgtaccgatcttctggatacggcaatggaatcggaaaaaggcactgaccggatgctggtttccaatgcgctcttagccctgacctggaactatatccagccgctcatcgaaaaaacacgggaggaattggaaatgcatggcgaggattccgctgccgatgctctggaagatcttctaggggatgaagtcagcagcggcgctcctcttccgaccggaaaaagcggtgccattccaaagaatatcaaaccagcttccccaaaaggaagcgggaatgatgagggcaatgctccttccggtccacgtaccaaagaggatgctatagaggaagccaaacaggtgctttcggaagaaggcgggcgcatcgctcttacaaagaccaataccattctggatgaaaacaaccccggcgtcacttatgtcagtcagtatcagggcagcggctatgagcatgctgcagaggatctgttccggatcttgaacgatgtggctgcagaaaaggtgcaggaagactgtcagacggaactgaccgaggaactgcagaaaacagccaatgatattcattacggcaatgcccatgcaggcatccatgttaccatccatcgcctgaccagtgtttccgattacctgaagaatgaataccagacagttgctcccccgctcctgcgggcttccaaaaagctgcaaagcaccatcctgccgcttttgaaagaagaacagcaaggcggaaagcagaagaatctcctgtttggaaaacgtctggactcccatgctctctataagacagacggaaccatctttaccagaaccagacttccaggagaggaaaaacgtctggctgttgccctcctgattgacgagagtggttcgatgggttggggtgaccggatgacacatgcaagaaagactgccattgtcctttatgatttctgtaaaagcctcggtatccctatcaccatttacgggcattccacggatgcaggcggcgttgctctttactcctatgcagaatttgattctgtggacaatgaggactgttaccggctgatggatatgtgcgaccgcaacgggaaccgggacggcgcagctctccgcttcgtagcagagcatttgtgcacacgcccggagcttcagaagctgctgatcctgatttctgacggtcagccagccgattacggctacagcggaacggaagcagaggcagatctgcggggcatcaagaaagaatacgaaaaacgagatgtcatcctgtttgcggctgccattggtgacgataaggaaaatatccgcaggatttacaaggacggattcctggatatcacgaaactggaagagcttccaaagaatatggcacagcttgtcaaacagcatctcaaataaaggaaggtgaatactcatgaatgaaacttatcaaaaccggattaccgaccagatctgcaagatccagaatgaccgggcactcattgccttttatgaccggctccgctacgcaccactcggcaactatgcacagctacatgccaaaggggaatatcaggaaaacgggcataaagtacattctttaatctgcatcaccattcaggattattccaacggtaccggagaccggaatatcatcacccgtttcaacctggcaccggaacagatccagttcctcttaacccggatcacttccggttttcaggaatttgaatggagccagagcaagatctacggcaatcccgatcagaacggttattccacagcccagatgttttatatctccagacatccctatgattccaaagggcagcctatgaaaagcccatggaaaatccagattgtaaatgggaaaggcatcaaagcacagaataagaacggtggttcctacatgcagccacgcagcttccagtccgaaaagacgacagccatccagcttaccgacatggatctgttcacgcttctgaagcggacggattcctatatttccaactgggaaacggtgattgctgcatcactgatcaataacggaaaacggatgctggcagaccagcagaacagtcaaatgcaacagacagcacaggctccgccttacgctgcctaaattttcagaagagaagcggtactttactgcttctcctctttttaagaaaggagactttagttatgaatattgcactcatccggaccatggactctcaggggcgtatcgtcatccctgcagaaatccggaaacaaatgaagctctcagacggagatgcactggaactggaaaatgtgggaatggagctgcttttacgcaaatgccctacccacttaaacggaaaagaggaaatggcttcctatctttccgtcctctacagtgtcatccactgtggtatcgcaatttgcagtgaggctcacatactcgtatctgcgggcatctatcttccggaaggcactcccgttacagaagaactcgccgaattggttgcggacggccaggaactgatctctgctgagaactgccctgtctacccggtatccaacacccgtcaaccggtttgtgcttttttcccgattttaagggaagacagagagccgctggcacttcttctctgttccagaaccggacagcatttatccgagatggaattgggatgcgctaaactggtcgctgccgtaattgcaaacaaaattaagtaaggaaaggagcgtgaaatcaatgaagaatacaaatataaccttacacaccacccaaaagaaagaatatgtcctcaccggaatcctgtccctgcccctccatctgggagaacgggcgtggatctatagttataaccagacctttgctaccagtccggtgcagagtattctggaagtatccgaaaacggtgtggtatttgagacctgcaacagtatttaccgtctcagctacacccgtgttccgatggagctggaggcgatgtgtgcttgacaagaatggaagaactggagagctgcctttcggggctcctctccaccttaaagaagaaccgggaacatgtgcctctggaagtgctgaagacacagtataagcagccgtatgaagaactggtcagaaacatcaacctgaccgcttctgcctatgcaaaatctgtgctgctccaccggctggtcctgaatccggatgcagatgtggaggaacaatgtaccgtcatcaaccagatgatacaaacttccgggatgctgaagaaaatcagctcctgcatgtccaaaacctatgatgtaggacagatatatcctctgatactggaactacgccatatggtcgaacaggcactctggccctatgtgaatcaggcaacttgtctggtcgcagatctggatgatatagaaaaagaaccgacaatttacaattttttgacacatgaagtttatgaaaatgatacctggattcaccgagaaatcgacctgcgctggaaactactggtacatcttactcccgaacaaagagaatccgtaccaccagccaatcatagtatgaatggaggaatttaccatgaaagaacaaccatctaatccttgcgagaaagtctcatttattttgacctatgaccagcttgaagctgcttataacatctaccgggaacaatttatttcctgcgacttcatccgccgctccatggaacgtctggaggaaagaatcggactctgcaaccttccatatgaaacgctgcgtgatgatccaagccttcttcatgaagcatacctgcagtttctccgactggaagactgcaatgtggcttataacgacacgctggagcaggtaattgatgcaatcgaacaatggcttgcctctggcaccttatcccctgtaaaccttacggtttccaaccagaatatgggtgaaacttttggaacggaggtggatgtgtaatggcaaatatctgctgtgatgatgtgatcttttatacagaaggaaatccggaaggactatatgacttgtgggaggacctggaaacctacatcattctgaaccagaatcctgatttatgctggattggcaatttattttcccacaagaaaatagattccaccggaatatctcttcgtggaaatgtcagctacatggaatggaatgatacgtatattctactttctttagagacagcatggattccactttatgaagcatatcaggcgatagccgctgcatatcatgttccctttgtgatgcaaagcatagaacctggagaacgaatttattataacacggatgaagcacacctatttttccctgaccgatattgtgtccgcttatatgaagaaagcctattgactccatgtggcttaataatcggagaaaagctggaagacggtgaaccatttgaaacggaaacagacgtattagaacgattcagagattgcggatatccagcagctacactaaaagagttggagctcatgttcgatgcggatgaacttattatttttgaatttacaaatccatatttggatctggagcagaaaaatgcttgtgcatgaaacttctcccctccacaccaaagacgattatcatcagatttaaaggaggaacaccatgactgatttggaactggatgtctgggatgcatggctcagggaacgtcaggaacatctggaagaaaccctgtccaatatctcaccatcggaagaaccctgcagatattacctgctaaccggatatattcagggaatgctagaagctcttaccatgcttacgactgttgaggatgggaaacgcttcaagatcaaactggagcaatttcgccagaatctgctcctctctggagattacgatgctaccggtaactataaacaggcagtgaagaaaactgctgtttaaatacttcgagccgcccaatcggacggctctttttatgcccgaaaacggtagcctacaccacgtatcgtttctatgtagtgcggttcttccggattttcttctattttctttctcagattcttgactaacccatagacacggttatccacttctgactccacatcctcataaatatgctggtaaatctgttcttttgtaaatacccgattgggggataaggccagataaaaaagcaggtcatattcatgtctggtaagttccacaaccttaccatctttgattacgctccgctgaagctggtctatttccaaaccttggaatgtcaacttttcagaatttgtaatctccataacttctaacgtactttcgcaggctagaactgatttaattttattcaggattccctcttcggaatcagaaatggtaagaatcatcactttcccataacatcacctgcttttcttagcatttagctttcactcctcattaacaatgtttatcgattggttacatagatatatgcatcttccaaagttacgtcacaagctatacatccactttctgacggcatattctcccctaacagtcttaatctaattccttcctccgtatactgcttactggaaatatgatattttctttctaattctcttgcaaggctttcgtcctctgtacagcattcccatacatgccctcttgccttattcaataattccctcattgttcctgtataaaggaatctaccttttttcataaccgcaagctgattacaggttgccatcagatcctccaccacatgcgttgaaaataatacggtgcgttcttctgcaaaatctaccagtaaattacggatacggatgcgttcctccggatcgagccctgttgttggttcatccacaattaaaaaatccggctcatggagtaatgcctgcactaatccaactcttcgcttcattccacctgaaagctgccgcattttctttttctgatggtctgcaagactggtcttctccagatagtaatcaatccttttcttgctttctcttttctcaattccagccagatctcccatatactccagacattctcgaacagtcaaagacggatacagatcaatttcctgtggcagatacccaatctttttctgtatcttttcgtaatttgcttcgcaatatagcgtaccatctaacagaacttttccacttgtgggtgcaagcaccgttgtaagcacccgcatcaacgttgtttttcctgcaccattttcacctaacagaccaaatatcccatgtgggatttccagatccacatgatctaccgctgtcactccatttttaaatgttactgttaaatcgtctattcttatactcataatcttaccctctcttctttaatatcttaggaacaaatgcaagcatcatccccgcaaataccacgcacagcaccttcccgccaagccatctccactctgtcagcttaccgaaatcacaagttccgtaggaaaatggtccccagtttttcaaaaactgagttgcctttccggaaatagagaaaaaccagaaaagcagcacgacacccataccaatccatctgtttcgaaccagattgctgacagttacggaaagcacactccaaaacaaaacagttccgggaatcgcaatacaataaattccaaacaaggcaccgccatctaattcttctgtcagattcaccggtttctgccaataaaagagtccatatgccaacaaactgattccaatcagataagctacctgcacaaatagtcttttataaactacccctgcctgcttttttagattataaaggcagaatacttccgagcgtttgctctgcacttccaccagataagtatctgcacagaaaacgactgccagaagcgaaacagctctttccactgcccctccgatttcgtttgcgtatacaacaggctggattgcactcaatatcacaacaaaagcgattgaatatgcaattttataatatggcatacatatttttacttctttcttcaatatactctcctccttttccacatccacaccgctataaacatgagcagtatggatgctgccacaagaagcagttgattgagatatacctgatgtggcaattccgtttcaaaaaaattccccggaaatcgaaccataatagagaatggtcttgcatgacactgtcctttgctatcccatgtcagcatattagaataaatgatataaagaaccagcgccggaaccgctggaagcggattcttaaacagcagcgctgtaaccgcatacacacagcagatcatcaggatgttcggcaggacatacaggatcgaattctgaacaaaatccagtatgttcatagcaaatcctgattttactgccgtggcgtaacacaaaatgataaatacgatattcataatgaccagtgccgccgtcataatgagaaatccactgcttattttcccggcaatatattgaaaagccgtcatcggtttggtgtgcagcaattcataagtatttttcctcatatcctggaaaaataaaaacgccagcagaaccgttgcaaagaatgccatatgcaggcttgcaaaatctgtaaattttcttccgaaataataggagaatggatgtttctcaagattttctctgatataccggttgacttcctccgggcttccctgataccatgaaacgtcctcatacacataattggcaccattaaagtggtattccgttttcagatactgacacgcctccgtaatcttcatctgtttcatctcagatatcactgcctccgcctctacttccgacatgccaaacccattctctgtgtcctgaagtatctttacaatctctttctcccacagttctctctccttatccggtgttgccggaatacatccctccataacatccccatcggaggccatttttaccttcctgaaggtttcatccgacttcacgtaatgaatggacagatagggtgcaagtgtctggtacatactgattaaaacaacaatcaaaccgatccagaatatcggatttttaagataatttttcagattcctttttatgattgctttcataagtcatcccgcctttcttttttctacaaacagcatagcctacaaatcacaacaaaaaaacaacagccatttatttctgctgttgttcttctaatacataatttttaaacactgcctcaacttccgcaccgccatctgctacattttttatcagcagtttcccaccatgccgttcgcagtagatacggctgatatacatacccattccaaaatgctttaagtcatcctgtggattctcatgataaaacgcctgtgtcaccctgtcgatattttcctgaaatccaattccgtcatccctgatactcattttcagatattggggtgtcactgtcagcttcagcctaacttcctgattggcatagcggaatgcgttagccaacagattatccgctacttccatgatgatttcctcatccgcagtcagtatttcagattctctcactgtcgtcactgtaaaattcttttctgatttttccaccacgacttctgccagagcttctatctggtttatcaactgccggatatctaccacggaacagtttaattcccgttcttccaatttcgtcatcttcctcatactatcaataaaatggttcatccgttcaatctgaagcataccgccccttaacatctccatcattttctcttgatcaagcatatcttccggaacaaattccaaaagcatttcctgatatccccgcatgattgcaagcggcgagcggatatcatgggcaatcgctgcacgcagtacccgctcatcttcgatcatctgccaaagtctacggttattttcttccaactgcccacgcatcctttcaaattccctgcacagcatccccatctcgtcctcgttctcataagccatatgaaaatccagatcttcctccgcaatcatctgtgatgccatcttcagttcctgaatcggtctctttaatttatttttgtaaaacaggctgaccgcaattccacatccggcaaaagaaaaaagcaatactccgtacgtccgaaggaaatcacaggtttctgaaatatgccagtccattctgctcattttactctgattcggtctcggtaccactacctcaaaattttcattgcggtcattcattgcctgataatactcgtcctgatccacgtacttccaccagacctcctcctgtatctgcccggcaatctcaataattgacacagaaagaaaaaaagtgacaatcaagctgagtatcgtatataaaaccattgtctttttcaaggataaatttcttatcttttccatcgataccccatcccccatactgtctcaatgtattctgtctgcgtatattccgccagtttctttctcactctccggatcagttccgtaacaacacggctgtcaccttccgcatcataaccacacaccttttcgtatatccgctccctgtcaaaaacctgtcctggattcatggacaaaaactcaatgattgcatattccagcttcgtaagctccaaatcattttcaccgatctgaaccctctttgctccataatcaatactgaggtctccgtggaatctgtattcagacttccctttatgacgctcctcacgcttcaaatgtgcaataatacgagcatccagttctttcagactaaacggcttcagtatatagtcatccccaccggataaaagcccgtttaccctgtcctgctcctccacttttgccgtcaggaagataatgggacaagttactttgccccggatacgtctgcatacttctaatccgtctattttaggcatattgatgtccagcaagataatatccggtttcttatggattttttccaaagcatctgtgccatcttctgccatcattacatcatatcgtttgatttcaaaatagttctttaacatctttaataattcgatgtcatcatccacgatcaaaattctatatgccacttttatcacctcgttttatcagtatacaacgaaaaaaacaataaataaacaacaagagaaacacttcgagccgcccattgccggacggctccttttatgcccgaaagcgataaccaacaccacgtatcgtttctatgtagtgcggtgtttccggattttcttctattttctttctcaagttcttaatcagaccgtaaattcggttattcacttctgactccgcttcctcatagatatgctgatagatctgttctttcgtgaatacccgattaggagataaagcaaccacagcgatttgcttcaaaagtctctttcgcctggtataccgtttataacttctcatgtttatcaccttcaatctgctttcaaatttaataatctatattttatgacaattcagcatatagaaaagttagttattcgtgaaaattatttttaaatttagaacttgcataaccactacgatgtaaaaacagtttagaggcatttatgacagagattgattttatctggttttcgactttctccacgaaagtggcaaaaaatacctggctacgaattccttcgcttagggcaaatctgaaatcctgaacgcttttattcctgtagccgacaaatttgtcatcaacataaggcaaaagcttcattgaggaatctatttcatttgacatatactacatctagtgttatactgttcttatatcaattatttgtgtcaatccggaaaggatttatcacacgcagtttaggtttgaaacgtagtcaggagttttcctatgcccaacaagcagcagggacttctggctttttttattttgcaggaaactgcatctattttgagaatgaacataagcgtcattctctttttttatgcctgaacgcagggaaaggaggattacggaaacaaatgattccggaactggcacgccacaaaagaaaggagactctatgtcagtcaaaagaattaagaatcttgtaaaacaactcaatgaataccgtcatgcctactacaatcaggatgcccctctggtatctgatgccgagtatgaccgactctttgacgaactgaaggaactggaggaacagactggtttcatcctgtcaaattctccgacacagacggttggatattatccggtcagtgaacttgccaaagtcacccatccgattccactgctctcgctcgagaaaacaaaactgatttcagagcttttagatttcatgaaaggacaggaagttctctttatgctgaaactggacggtttgactaccaaactcatttacgaagatggcagactgattcaggcttctacccgtggagatggtgaagtgggggaagatattacacacaatatcccggcatttttaaatgtaccgcttaccattccacacaaagaacgtctggtcattaccggtgagtcttttataccaaccaatgattttgaacgtctgaaagatactctgcgtgatggaaatggaaaaccttataaaaacggacgtaattttgcttccggatcagtacgaagtcttgatccgaagaactgtatcggacgttgtgttcgctttcttccgttcaatgtattagaaggaatggaggatgttcccttcccggacagcagagcctgcaaattagaaggtttaacacacctgggctttggttactgcccgtttttctcaatttcaggaaccggactttcaaaagaatatgcggagaaattcattcaggaattggtatccacagcagcaaatttacatcttcctatcgatggcattgtcatgatttttgacagtctcagctactccaaaagctgcggaaaaaccggacaccactataaggacggcctcgcctataagtttgaggatgatacctacgaaactttcttgcgtgaaattgaatggacaccgaccagattcggagagattgctccggtcggcatcttcgataccgtggagattgacggctgtgatgtttccagagcttcccttcataatctgacctttatcaaaaatctggagcttgtacccggatgccggattcttgtttccaaacgaaacatgatcatcccacatatagaggataatctggatcgtggaaggtataccgacatcacgcctccggtctgcccttgctgtggttccaaaaccagaacctacagccgtaagaccagcgacggtcgcaccgtagaaactctgcattgtgataatccgcagtgcgacagccagatcacaagaaggtttgtccattttgccagcaagaaggcaatgaacatcgaaggactgtcagaagccactttaga
